(12) United States Patent
Lajoie et al.

(10) Patent No.: US 11,866,699 B2
(45) Date of Patent: Jan. 9, 2024

(54) GENOME EDITING REAGENTS AND THEIR USE

(71) Applicant: UNIVERSITY OF WASHINGTON, Seattle, WA (US)

(72) Inventors: Marc Joseph Lajoie, Seattle, WA (US); Elizabeth Erin Gray, Seattle, WA (US); Neil P. King, Seattle, WA (US); Daniel Brewster Stetson, Seattle, WA (US); David Baker, Seattle, WA (US); Katherine DaPron, Seattle, WA (US)

(73) Assignee: UNIVERSITY OF WASHINGTON, Seattle, WA (US)

( * ) Notice: Subject to any disclaimer, the term of this patent is extended or adjusted under 35 U.S.C. 154(b) by 1081 days.

(21) Appl. No.: 16/476,917

(22) PCT Filed: Feb. 12, 2018

(86) PCT No.: PCT/US2018/017796
§ 371 (c)(1),
(2) Date: Jul. 10, 2019

(87) PCT Pub. No.: WO2018/148647
PCT Pub. Date: Aug. 16, 2018

(65) Prior Publication Data
US 2019/0352639 A1 Nov. 21, 2019

Related U.S. Application Data

(60) Provisional application No. 62/457,369, filed on Feb. 10, 2017.

(51) Int. Cl.
| | | |
|---|---|---|
| *C07H 21/04* | (2006.01) | |
| *C12N 15/11* | (2006.01) | |
| *C07K 14/005* | (2006.01) | |
| *C12N 9/22* | (2006.01) | |
| *C12N 15/85* | (2006.01) | |

(52) U.S. Cl.
CPC ............ *C12N 15/11* (2013.01); *C07K 14/005* (2013.01); *C12N 9/22* (2013.01); *C12N 15/111* (2013.01); *C12N 15/85* (2013.01); *C12Y 301/21* (2013.01); *C12N 2310/20* (2017.05); *C12N 2800/80* (2013.01); *C12Q 2521/301* (2013.01)

(58) Field of Classification Search
None
See application file for complete search history.

(56) References Cited

U.S. PATENT DOCUMENTS

| | | |
|---|---|---|
| 7,682,618 B2 | 3/2010 | Bavari et al. |
| 8,697,439 B2 | 4/2014 | Mangeot et al. |
| 8,969,521 B2 | 3/2015 | Baker et al. |
| 9,381,239 B2 | 7/2016 | Smith et al. |
| 9,593,356 B2 | 3/2017 | Haugwitz et al. |
| 9,695,446 B2 | 7/2017 | Mangeot et al. |
| 2009/0041724 A1 | 2/2009 | Jensen |
| 2012/0322147 A1 | 12/2012 | Mangeot et al. |
| 2014/0356943 A1 | 12/2014 | Mangeot et al. |
| 2015/0067922 A1 | 3/2015 | Yang et al. |
| 2015/0259684 A1 | 9/2015 | Church et al. |
| 2016/0186152 A1 | 6/2016 | Brouns et al. |
| 2016/0206566 A1 | 7/2016 | Lu et al. |
| 2016/0264982 A1 | 9/2016 | Zhu et al. |
| 2017/0130197 A1 | 5/2017 | Haugwitz et al. |

FOREIGN PATENT DOCUMENTS

| | | |
|---|---|---|
| CN | 105283553 | 6/2016 |
| EP | 1 543 837 | 6/2005 |
| EP | 1 827 394 | 9/2007 |
| WO | WO 2003/039477 | 5/2003 |
| WO | WO 2006/059141 | 6/2006 |
| WO | WO 2008/148104 | 12/2008 |
| WO | WO 2014/124301 | 8/2014 |
| WO | WO 2014/200659 | 12/2014 |
| WO | WO 2015/191911 | 12/2015 |
| WO | 2016/138525 A1 | 9/2016 |

OTHER PUBLICATIONS

Tang, Y., Fu, Y. Class 2 CRISPR/Cas: an expanding biotechnology toolbox for and beyond genome editing. Cell Biosci 8, 59 (2018).*
Sun et al, "Cyclic GMP-AMP Synthase Is a Cytosolic DNA Sensor That Activates the Type I Interferon Pathway", Science 339:786-791 (2013).
Théry et al, "Isolation and Characterization of Exosomes from Cell and Culture Supernatants and Biological Fluids", Current Protocols in Cell Biology 3.22.1-3.22.19 (2006).
Tobium et al., "Nef Does Not Affect the Efficiency of Human Immunodeficiency Virus Type 1 Fusion With Target Cells", J Virol, 77(19): p. 10645-50 (2003).
Usami et al, "SERINC3 and SERINC5 Restrict HIV-1 Infectivity and Are Counteracted by Nef," Nature 526:218-23 (2015).
Votteler et al, "Designed Proteins Induce the Formation of Nanocage-Containing Extracellular Vesicles", Nature 540, 292-295 (2016).
Votteler et al, "Virus Budding and the ESCRT Pathway". Cell Host & Microbe, 14:232-41 (2013).
Wang et al, "Expanding the Genetic Code of *Escherichia coli*", Science 292, 498 (2001).
Wang et al, "Genetic Screens in Human Cells Using the CRISPR-Cas9 System", Science 3;343(6166):80-4 doi: 10.1126 (2014).
Wu et al, "Cyclic GMP-AMP Is an Endogenous Second Messenger in Innate Immune Signaling by Cytosolic DNA", Science 339: 826-830 (2013).
Yang et al, "Engineered Lentivector Targeting of Dendritic Cells for in Vivo Immunization", Nat Biotechnol 26(3):326-34. doi: 10.1038/nbt1390 (2008).

(Continued)

*Primary Examiner* — Kimberly Chong
(74) *Attorney, Agent, or Firm* — MCDONNELL BOEHNEN HULBERT & BERGHOFF LLP

(57) ABSTRACT

The application discloses multimeric assemblies packaging one or more active component and their use to carry out nucleic acid regulation or gene editing.

15 Claims, 10 Drawing Sheets

Specification includes a Sequence Listing.

(56) References Cited

OTHER PUBLICATIONS

Yang et al, "One-Step Generation of Mice Carrying Reporter and Conditional Alleles by CRISPR/Cas-mediated Genome Engineering", Cell 12;154(6):1370-9. doi: 10.1016 (2013).
Yee et al, "Generation of High-Titer Pseudotyped Retroviral Vectors With Very Broad Host Range", Methods in cell biology, 43 Pt A: p. 99-112 (1994).
Zacharias et al, "Partitioning of Lipid-modified GFPs into Membrane Microdomains in Live Cells", Science 296:913-916 (2002).
Zetsche et al., "Cpf1 is a single RNA-guided endonuclease of a class 2 CRISPR-Cas system." Cell 163(3):759-71 (Epub Sep. 25, 2015).
Zhao et al, "A Simple Guide to Biochemical Approaches for Analyzing Lipid-Protein Interactions", Mol. Biol. Cell 23:2823-30 (2012).
Apolonia, et al, "Promiscuous RNA Binding Ensures Effective Encapsidation of APOBEC3 Proteins by HIV-1", A Peer-Reviewed Open-Access Journal PLOS Pathogens 11:e1004609 (2015).
Bieniasz, "Late Budding Domains and Host Proteins in Enveloped Virus Release", Virology 344:55-63 (2006).
Biswas et al, "The Human Immunodeficiency Virus Type 1 Ribosomal Frameshifting Site Is an Invariant Squence Determinant and an Important Target for Antiviral Therapy", J. Virol 78:2082-7 (2004).
Bridgeman et al, "Viruses Transfer the Antiviral Second Messenger cGAMP Between Cells", Science 349:1228-32 (2015).
Cavrois et al, "A Sensitive and Specific Enzyme-Based Assay Detecting HIV-1 Virion Fusion in Primary T Lymphocytes", Nat. Biotech. 20:1151-4 (2002).
Chen et al, "Dynamic Imaging of Genomic Loci in Living Human Cells by an Optimized CRISPR/Cas System", Cell vol. 155, Issue 7, p. 1479-1491, (2014).
Chew et al, "A Multifunctional AAV-CRISPR-Cas9 and Its Host Response", Nat Methods 13(10):868-74 doi: 10.1038 (2016).
Cho et al, "Targeted Genome Engineering in Human Cells With the Cas9 RNA-guided Endonuclease", Nat Biotechnol 31(3):230-2. doi: 10.1038 (2013).
Cong et al, "Multiplex Genome Engineering Using CRISPR/Cas Systems", Science 15;339(6121):819-23. doi: 10.1126(2013).
De Guzman et al., "Structure of the HIV-1 Nucleocapsid Protein Bound to the SL3 psi-RNA Recognition Element", Science 279:384-8 (1998).
Dominguez et al, "Beyond Editing: Repurposing CRISPR-Cas9 for Precision Genome Regulation and Interrogation", Nat Rev Mol Cell Biol. Jan. 17;(1): 5-15 (2016).
Fernandes-Alnemri et al, "The AIM2 Inflammasome is Critical for Innate Immunity to Francisella Tularensis", Nature Immunology 11(5), 385-393 (2010).
Freed et al, "Single Amino Acid Changes in the Human Immunodeficiency Virus Type 1 Matrix Protein Block Virus Particle Production", J. Virol. 68:5311-20 (1994).
Gentili et al, "Transmission of innate immune signaling by packaging of cGAMP in viral particles", Science 349:1232-6 (2015).
Gosser et al, "Peptide-triggered conformational switch in HIV-1 RRE RNA complexes," Nature Structure 8(2):146-50 (Feb. 2001).
Gray et al, "Cutting Edge: cGAS Is Required for Lethal Autoimmune Disease in the Trex1-Deficient Mouse Model of Aicardi-Goutières SyndromeJ", Immunol. 195:1939-43 (2015).
Gray et al, "The AIM2-like Receptors Are Dispensable for the Interferon Response to Intracellular DNA", Immunity, 45(2):255-266 (Aug. 2016).
Griffiths et al, "Cloning, Isolation and Characterization of the Thermotoga Maritima KDPG Aldolase", Bioorganic & Medicinal Chemistry 10:545-50 (2002).
Hwang et al, "Efficient Genome Editint in Zerafish Using a CRISPR-Cas System", Nat Biotechnol (3):2279. doi: 10.1038 (2013).
Ishikawa et al, "STING Is an Endoplasmic Reticulum Adaptor That Facilitates Innate Immune Signalling", Nature 455:674-8 (2008).
Jiang et al, "RNA-guided Editing of Bacterial Genomes Using CRISPR-Cas Systems" Nat Biotechnol (3):233-9. doi: 10.1038 (2013).
Jinek et al, "RNA-programmed Genome Editing in Human Cells", Elife 29;2:e00471. doi: 10.7554 (2013).
Jones et al, "Absent in Melanoma 2 is Required for Innate Immune Recognition of Francisella Tularensis", PNAS 107(21), 9771-9776 (2010).
King et al, "Accurate Design of Co-assembling Multi-Component Protein Nanomaterials", Nature 510:103-108 (2014).
King et al, "Computational Design of Self-assembling Protein Nanomaterials with Atomic Level Accuracy", Science 336:1171-1174 (2012).
Kleinstiver et al, "Engineered CRISPR-Cas9 Nucleases With Altered PAM Specificities", Nature 523(7561):481-5. doi: 10.1038 (2015).
Kleinstiver et al, "Genome-wide Specificities of CRISPR-Cas Cpf1 Nucleases in Human Cells", Nat Biotechnol (8):86974. doi: 10.1038 (2016).
Kremer et al, "Computer visualization of three-dimensional image data using IMOD", J. Struct. Biol. 116:71-76 (1996).
Lawerence et al,"Shape Complementarity at Protein/Protein Interfaces", J. Mol. Biol. 234:946-50 (1993).
Lemmon, "Membrane Recognition by Phospholipid-binding Domains", Nat. Rev. Mol. Cell. Biol. 9:99-111 (2008).
Maggio et al, "Adenoviral Vector Delivery of RNA-guided CRISPR/Cas9 Nuclease ComplexesInducesTargeted Mutagenesis in a Diverse Array of Human Cells", Sci Rep 29;4:5105. doi: 10.1038 (2014).
Mali et al, "RNA-guided Human Genome Engineering via Cas9", Science 15;339(6121):823-6 doi: 10.1126 (2013).
Mangeot et al, "Protein Transfer into Human Cells by VSV-G-induced Nanovesicles", Mol. Therapy 19:1656-66 (2011).
McCullough et al, "Membrane Fission Reactions of the Mammalian ESCRT Pathway", Annu. Rev. Biochem. 82:663-92 (2013).
McDonald et al, "No Strings Attached: the ESCRT Machinery in Viral Budding and Cytokinesis", J. Cell Sci. 122:2167-77 (2009).
Nishimasu et al, "Structural Basis for the Altered PAM Recognition by Engineered CRISPR-Cpf1", Mol Cell 67(1):139-147.e2. doi: 10.1016 (2017).
Olsen, "Gene Transfer Vectors Derived from Equine Infectious Anemia Virus", Gene Ther, 5(11): p. 1481-7 (1998).
Orozco et al, "RIPK1 both positively and negatively regulates RIPK3 oligomerization and necroptosis", Cell Death Differ 21, 1511-1521 (2014).
Oubridge et al, "Crystal Structure at 1.92 A Resolution of the RNA-binding Domain of the U1A Spliceosomal Protein Complexed With an RNA Hairpin", Nature 372:432-8 (1994).
Parent et al, "Positionally Independent and Exchangeable Late Budding Functions of the Rous Sarcoma Virus and Human Immunodeficiency Virus Gag Proteins", J. Virol. 69:5455-5460 (1995).
Puglisi et al, "Solution structure of a bovine immunodeficiency virus Tat-TAR peptide-RNA complex", Science 270:1200-3, Science 270:1200-3 (1995).
Ran et al, "In Vivo Genome Editing Using *Staphylococcus aureus* Cas9", Nature 520(7546):186-91. doi: 10.1038 (2015).
Rathinam et al, "The AIM2 Inflammasome is Essential for Host Defense Against Cytosolic Bacteria and DNA viruses", Nature Immunology 11(5), 395-402 (2010).
Resh, "Covalent Lipid Modifications of Proteins", Curr. Biol. 23:R431-5 (2013).
Resh, "Fatty Acylation of Proteins: New Insights into Membrane Targeting of Myristoylated and Palmitoylated Proteins",Biochim. et. Biophys. Acta 1451:1-16 (1999).
Rosa et al, "HIV-1 Nef Promotes Infection by Bxcluding SERINC5 from Virion Incorporation", Nature. 526(7572):212-17 (2015).
Schumann et al, "Generation of Knock-in Primary Human T Cells Using Cas9 Ribonucleoproteins", PNAS 112 (33) 10437-10442 (2015).
Shalem et al, "Genome-scale CRISPR-Cas9 Knockout Screening in Human Cells", Science 3;343(6166):84-87. doi: 10.1126 (2014).
Shmakov et al, "Discovery and functional characterization of diverse Class 2 CRISPR-Cas systems", Mo Cell 60(3): 385-397 (2015).
Stahelin, "Lipid Binding Domains: More Than Simple Lipid Effectors", J. Lipid Res. 50:S299-304 (2009).

(56) References Cited

OTHER PUBLICATIONS

The International Search Report (ISR) with Written Opinion for PCT/US2018/17796 dated Aug. 9, 2018, pp. 1-22.

* cited by examiner

GENOME EDITING REAGENTS AND THEIR USE

RELATED APPLICATIONS

This application is a U.S. national phase of International Application No. PCT/US2018/017796, filed on Feb. 12, 2018, which claims priority to U.S. Provisional Application No. 62/457,369, filed Feb. 10, 2017, both of which are incorporated by reference herein in their entirety.

FEDERAL FUNDING STATEMENT

This disclosure was made with government support under Grant No. W911NF-15-1-0645, awarded by the U.S. Army Research Office. The government has certain rights in the disclosure.

BACKGROUND

Viral delivery of gene editing and gene regulation reagents is a promising strategy for engineering cells for research and clinical applications. However, viruses pose safety concerns, are immunogenic, and are expensive. Non-viral methods of delivering gene editing and gene regulation reagents into cells are lacking. Electroporation of nucleic acids and/or proteins into target causes cell death and aberrant gene regulation. Meanwhile nanoparticles exhibit poor in vivo targeting and pose toxicity concerns.

SUMMARY OF THE DISCLOSURE

In one aspect are provided compositions comprising:
(a) a multimeric assembly, comprising a plurality of oligomeric substructures, wherein each oligomeric substructure comprises a plurality of recombinant polypeptides that self-interact around at least one axis of rotational symmetry, wherein
  (i) each of the recombinant polypeptides comprises a polypeptide-polypeptide interface ("O interface"):
  (ii) one or more of the recombinant polypeptides comprises a polypeptide domain that is capable of interacting with a lipid bilayer ("M domain");
  (iii) one or more of the recombinant polypeptides comprises a polypeptide domain that is capable of effecting membrane scission and release of an enveloped multimeric assembly from a cell by recruiting the ESCRT machinery to the site of budding by binding to one or more proteins in the eukaryotic ESCRT complex ("L domain"); and
  (iv) one or more of the recombinant polypeptides comprises an RNA binding domain ("RBD");
wherein the M domain, the L domain, the O interface, and the RBD are not each present in a single naturally occurring protein; and
(b) one or more active component selected from the group consisting of:
  (i) one or more RNAs encoding a DNA binding protein, including but not limited to a genome editing protein, that is capable of being bound by the RBD;
  (ii) one or more RNAs comprising
    (A) one or more guide RNA (gRNA), wherein each gRNA comprises (I) a guide sequence capable of binding to a desired nucleic acid sequence; (II) an RNA packaging sequence capable of being bound by the RBD; and (III) a structural sequence capable of binding to a Class 2 Cas protein to form a Class 2 Clustered regularly-interspaced short palindromic repeats (CRISPR)-Cas ribonucleoprotein (RNP) complex; and
    (B) one or more mRNA encoding a Class 2 Cas protein and an RNA packaging sequence capable of being bound by the RBD; and/or
  (iii) one or more Class 2 CRISPR-Cas RNP complexes comprising a Class 2 Cas protein and one or more gRNA bound by the Class 2 Cas protein, wherein each gRNA comprises (I) a guide sequence capable of binding to a desired nucleic acid sequence; (II) an RNA packaging sequence capable of being bound by the RBD; and (III) a structural sequence capable of binding to a Class 2 Cas protein.

In various embodiments, each of the recombinant polypeptides comprises an L domain, each of the recombinant polypeptides comprises an M domain, and/or each of the recombinant polypeptides comprises an RBD.

In one embodiment, the active component comprises one or more RNAs encoding a DNA binding protein, including but not limited to a genome editing protein, capable of being bound by the RBD. In a further embodiment, the one or more RNAs encoding a DNA binding protein comprise an RNA packaging sequence capable of being bound by the RBD. In another embodiment, the RNA packaging sequence comprises or consists of a sequence that is at least 50%, 55%, 60%, 65%, 7%, 75%, 80%, 85%, 90%, 95%, 96%, 97%, 98%, 99%, or 100% identical over its length to the nucleic acid sequence selected from the group consisting of SEQ ID NOS:204-207, and 329. In another embodiment, the RNA packaging sequence is located 5' to each RNA encoding a DNA binding protein, 3' to each RNA encoding a DNA binding protein, or both 5' and 3' to each RNA encoding a DNA binding protein. In a further embodiment, the one or more RNAs encoding a DNA binding protein are selected from the group consisting of RNAs encoding a zinc finger DNA binding protein, Transcription Activator-Like Effector (TALE) protein, meganuclease, recombinase, integrase, transposase, single-stranded DNA binding protein, and nucleotide-modifying protein. In one embodiment, the one or more RNAs encode a DNA binding protein encode a deaminase.

In another embodiment, the one or more active component comprises:
  (A) one or more gRNA; and
  (B) one or more mRNA encoding a Class 2 Cas protein and an RNA packaging sequence capable of being bound by the RBD.

In a further embodiment, the one or more active component comprises one or more RNP complexes comprising a Class 2 Cas protein and one or more gRNA bound by the Class 2 Cas protein In one embodiment of each of these embodiments, the RNA packaging sequence comprises or consists of a sequence that is at least 50%, 55%, 60%, 65%, 7%, 75%, 80%, 85%, 90%, 95%, 96%, 97%, 98%, 99%, or 100% identical over its length to the nucleic acid sequence selected from the group consisting of SEQ ID NOS: 204-207, and 329. In another embodiment, the structural sequence comprises or consists of a sequence that is at least 50%, 55%, 60%, 65%, 7%, 75%, 80%, 85%, 90%, 95%, 96%, 97%, 98%, 99%, or 100% identical over its length to the nucleic acid sequence selected from the group consisting of SEQ ID NOS:332-335. In a further embodiment,
  (a) the guide sequence is located 5' to the structural sequence in the gRNA, and wherein RNA packaging sequence is located 3' to the structural sequence in the gRNA; or (b) the guide sequence is located 3' to the structural sequence in the gRNA, and wherein RNA packaging sequence is located 5' to the structural sequence in the gRNA.

In another embodiment, the gRNA further comprises an RNA stabilization sequence, such as the sequence of SEQ ID NO:336. In various further embodiments, the gRNA comprises or consists of a sequence that is at least 50%, 55%, 60%, 65%, 7%, 75%, 80%, 85%, 90%, 95%, 96%, 97%, 98%, 99%, or 100% identical over its length to the nucleic acid sequence selected from the group consisting of SEQ ID NOS:337-361 and 411-414. In another embodiment, the Class 2 Cas protein comprises an amino acid sequence having at least 50%, 55%, 60%, 65%, 7%, 75%, 80%, 85%, 90%, 95%, 96%, 97%, 98%, 99%, or 100% identity along its full length to the amino acid sequence selected from the group consisting of SEQ ID NO:367-372, or the amino acid sequence of a protein listed by Uniprot database accession number in Table 1. In another embodiment, the mRNA encoding a Class 2 Cas protein comprises a nucleotide sequence having at least 50%, 55%, 60%, 65%, 7%, 75%, 80%, 85%, 90%, 95%, 96%, 97%, 98%, 99%, or 100% identity along its full length to the nucleic acid sequence selected from the group consisting of SEQ ID NO:373-378.

In another embodiment, the RBD comprises the amino acid sequence selected from the group consisting of SEQ ID NOS: 198-201, and 330.

In various further embodiments, the one or more O interfaces orient the plurality of oligomeric substructures such that their symmetry axes are aligned with symmetry axes of the same kind in a designated mathematical symmetry group; the one or more O interfaces of each oligomeric substructure are identical; the one or more O interfaces are non-naturally occurring; and/or the one or more O interfaces comprise or consist of the amino acid sequence of SEQ ID NO: 1-5, 7-9, 20, or 304. In other embodiments, the one or more L domains are capable of non-covalently interacting with one or more proteins in the ESCRT pathway, and/or the one or more L domains comprise a linear amino acid sequence motif selected from the group consisting of SEQ ID NOS: 152-197 or 305-306, or overlapping combinations thereof. In further embodiments, the one or more M domains comprise a polypeptide having an acylation motif (including but not limited to N-terminal myristoylation motifs, palmitoylation motifs, farnesylation motifs, and geranylgeranylation motifs), a polar headgroup-binding domain (including but not limited to those described herein and in the attached appendices), envelope proteins of enveloped viruses, membrane protein transporters, membrane protein channels, B-cell receptors, T-cell receptors, transmembrane antigens of human pathogens, growth factors receptors, G-protein coupled receptors (GPCRs), complement regulatory proteins including but not limited to CD55, CD59, and transmembrane protein domains and/or the one or more M domains are selected from the group consisting of SEQ ID NOS: 52-151 and 280-300.

In another embodiment, the recombinant polypeptide comprises the amino acid sequence selected from the group consisting of SEQ ID NOS:266 and 379-387.

In a further embodiment, the composition further comprises a lipid bilayer enveloping the multimeric assembly, wherein one or more of the M domains is bound to the lipid bilayer. In a further embodiment, one or more transmembrane protein or membrane-anchored protein is embedded in the lipid bilayer; exemplary transmembrane or membrane-anchored proteins are selected from the group consisting of the envelope proteins of enveloped viruses, membrane protein transporters, membrane protein channels, B-cell receptors, T-cell receptors, transmembrane antigens of human pathogens, growth factors receptors, G-protein coupled receptors (GPCRs), complement regulatory proteins including but not limited to CD55 and CD59, or a processed version thereof. In one embodiment, the one or more transmembrane protein or membrane-anchored protein embedded in the lipid bilayer comprises one or more polypeptide selected from the group consisting of SEQ ID NOS: 307-315 and 331, or a processed version thereof. In one embodiment, the one or more transmembrane protein or membrane-anchored protein embedded in the lipid bilayer comprises a cell-targeting polypeptide displayed on an outer surface of the lipid bilayer. In another embodiment, the composition comprises a non-viral cell-targeting polypeptide linked to the one or more transmembrane protein or membrane-anchored protein embedded in the lipid bilayer, wherein the non-viral cell-targeting polypeptide is displayed on an outer surface of the lipid bilayer. Exemplary non-viral cell-targeting polypeptide include, but are not limited to, an immunoglobulin including but not limited to an scFv, a F(ab), a F(ab')$_2$, a B cell receptor (BCR), a DARPin, an affibody, a monobody, a nanobody, an antibody; a cell-targeting oligopeptide including but not limited to RGD integrin-binding peptides, and conotoxins.

In another aspect is provided recombinant host cell capable of producing the composition of any embodiment or combination of embodiments of the disclosure. In one embodiment, the host cell comprises (a) one or more expression vectors capable of expressing the plurality of recombinant polypeptides that self-interact around at least one axis of rotational symmetry; and (b) an expression vector capable of expressing the one or more RNAs encoding a DNA binding protein, including but not limited to a genome editing protein, that is capable of being bound by the RBD.

In another embodiment, the host cell comprises (a) one or more expression vectors capable of expressing the plurality of recombinant polypeptides that self-interact around at least one axis of rotational symmetry;

(b) an expression vector capable of expressing the one or more gRNAs; and (c) an expression vector capable of expressing the one or more mRNA encoding a Class 2 Cas protein and an RNA packaging sequence capable of being bound by the RBD.

In a further embodiment, the host cell comprises (a) one or more expression vectors capable of expressing the plurality of recombinant polypeptides that self-interact around at least one axis of rotational symmetry;

(b) one or more expression vector capable of expressing the one or more gRNAs; and (c) one or more expression vector capable of expressing the Class 2 Cas protein.

In various further embodiments, the recombinant host cell may further comprise one or more expression vector capable of expressing a cargo, a transmembrane or membrane-anchored protein, and/or a cell targeting polypeptide.

In a further aspect are provided recombinant nucleic acids comprising:

(a) a first nucleic acid domain encoding an RNA guide sequence capable of binding to a target nucleic acid sequence;

(b) a second nucleic acid domain encoding an RNA packaging sequence at least 50%, 55%, 60%, 65%, 7%, 75%, 80%, 85%, 90%, 95%, 96%, 97%, 98%, 99%, or 100% identical to the sequence selected from the group consisting of SEQ ID NO:204-207, and 329 and capable of being bound by an RNA binding domain; and (c) a third nucleic acid domain encoding a structural sequence capable of binding to a Class 2 Cas protein to form a ribonucleoprotein complex.

In one embodiment, the structural sequence comprises or consists of a sequence that is at least 50%, 55%, 60%, 65%, 7%, 75%, 80%, 85%, 90%, 95%, 96%, 97%, 98%, 99%, or 100% identical over its length to the nucleic acid sequence selected from the group consisting of SEQ ID NOS:332-335. In other embodiments:

(a) the guide sequence is located 5' to the structural sequence in the gRNA, and wherein RNA packaging sequence is located 3' to the structural sequence in the gRNA; or (b) the guide sequence is located 3' to the structural sequence in the gRNA, and wherein RNA packaging sequence is located 5' to the structural sequence in the gRNA.

In a further embodiment, the recombinant nucleic acid may further comprise a fourth nucleic acid domain that encodes an RNA stabilization sequence. In other embodiments, the recombinant nucleic acid encodes a sequence that is at least 50%, 55%, 60%, 65%, 7%, 75%, 80%, 85%, 90%, 95%, 96%, 97%, 98%, 99%, or 100% identical over its length to the nucleic acid sequence selected from the group consisting of SEQ ID NOS: 337-361 and 411-414.

In another aspect are provided recombinant nucleic acids encoding a RNA expression produce comprising a DNA binding protein linked to one or more RNA packaging sequence capable of being bound by an RNA binding domain, wherein the one or more RNA packaging sequence is located 5' to the RNA encoding a DNA binding protein, 3' to the RNA encoding a DNA binding protein, or both. In various further aspects are provided a recombinant nucleic acid, encoding the RNA sequence selected from the group consisting of SEQ ID NOS:373-378, expression vectors comprising the recombinant nucleic acids of the disclosure, and host cells comprising the expression vectors.

In a further aspect is provided a gene regulation method comprising:

(a) expressing in producer cells the composition of any embodiment or combination of embodiments of the disclosure, such that the DNA binding protein, the RNA encoding a Class 2 Cas protein, and/or the Class 2 Cas protein-containing RNP complexes are packaged in the membrane envelope of the producer cell to produce a gene regulation vesicle;

(b) purifying the gene regulation vesicle from the producer cells; and (c) incubating the gene regulation vesicle with recipient cells for delivery of the DNA binding protein, the RNA encoding Class 2 Cas protein, and/or the Class 2 Cas protein-containing RNP complexes, wherein gene regulation by the DNA binding protein and/or the Class 2 Cas protein occurs in the recipient cell.

(D) RFLP analysis of AIM2 gene editing (% of edited alleles) 3 days after delivery of 12 µg Cas9/gRNA EPNs to 50,000 HEK293T cells. Note: EPNs were centrifuged at 1000 g for 5 minutes to remove debris, and EPNs in the supernatant were delivered to recipient cells.

Figure 10:
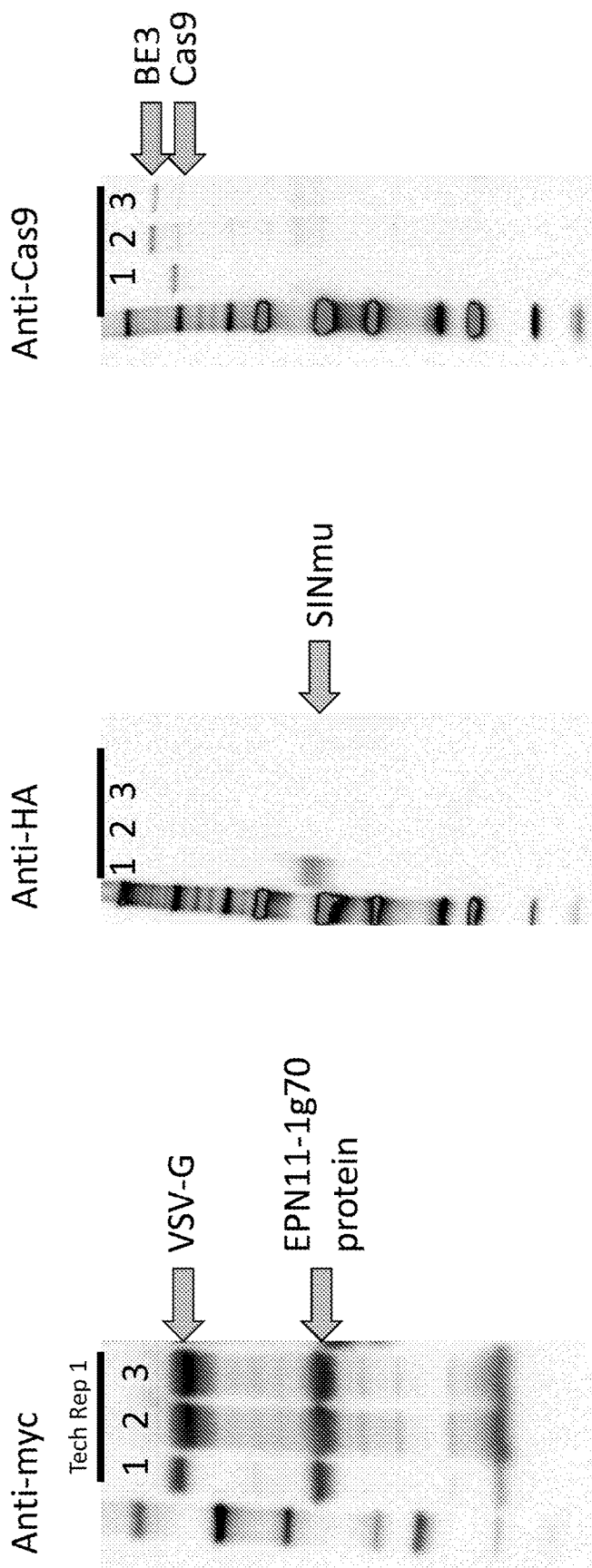

FIG. 10: Production of EPNs with split targeting/fusion polypeptides and EPNs packaging Cas9-deaminase. EPNs bearing split envelope proteins were produced by transfecting plasmids encoding the following functional components into 25 mL of 293F cells: the EPN structural protein (10.2 µg DNA), a variant of the Sindbis virus fusion protein with its receptor binding function inactivated (SINmu, 5.1 µg DNA), a variant of the Vesicular Stomatitis Virus glycoprotein (VSV-G) with its fusion function inactivated (1.5 µg DNA), a Cas9 protein (3.1 µg DNA), and a gRNA containing the 1 g70 RNA packaging sequence (5.1 µg DNA). EPNs packaging Cas9-deaminases were produced by transfecting plasmids encoding the following functional components into 25 mL of 293F cells: the EPN structural protein (13 µg DNA), VSV-G (1.9 µg DNA), a Cas9 protein (3.8 µg DNA), and a gRNA containing the 1g70 RNA packaging sequence (6.4 µg DNA). Expressions were harvested after 38 hours, the producer cells were removed by centrifugation and filtration through a 0.45 µm filter, and the EPNs were purified by ultracentrifugation over a 5 mL 20% sucrose cushion for 2 hours at 70,000 g at 4° C. The pelleted EPNs were resuspended in 250 L DMEM, and a 1:10 dilution was analyzed by Western blot. EPN proteins (33 kDa) and VSV-G (59 kDa) were probed with an anti-myc antibody, SINmu (54 kDa) was probed with an anti-HA antibody, and Cas9 (165 kDa for Cas9 and 197 kDa for BE3) was probed with an anti-Cas9 antibody. BE3 refers to the rAPOBEC1-Cas9-UGI deaminase.

DETAILED DESCRIPTION

All references cited are herein incorporated by reference in their entirety. As used herein, the singular forms "a", "an" and "the" include plural referents unless the context clearly dictates otherwise. "And" as used herein is interchangeably used with "or" unless expressly stated otherwise.

All embodiments of any aspect of the invention can be used in combination, unless the context clearly dictates otherwise.

Unless the context clearly requires otherwise, throughout the description and the claims, the words 'comprise', 'comprising', and the like are to be construed in an inclusive sense as opposed to an exclusive or exhaustive sense; that is to say, in the sense of "including, but not limited to". Words using the singular or plural number also include the plural and singular number, respectively. Additionally, the words "herein," "above," and "below" and words of similar import, when used in this application, shall refer to this application as a whole and not to any particular portions of the application.

As used throughout the present application, the term "protein" or "polypeptide" are used in their broadest sense to refer to a sequence of subunit amino acids. The proteins or polypeptides of the disclosure may comprise L-amino acids, D-amino acids (which are resistant to L-amino acid-specific proteases in vivo), or a combination of D- and L-amino acids. The proteins or polypeptides described herein may be chemically synthesized or recombinantly expressed.

The description of embodiments of the disclosure is not intended to be exhaustive or to limit the disclosure to the precise form disclosed. While the specific embodiments of, and examples for, the disclosure are described herein for illustrative purposes, various equivalent modifications are possible within the scope of the disclosure, as those skilled in the relevant art will recognize.

In a first aspect, the present invention provides compositions comprising:
 (a) a multimeric assembly, comprising a plurality of oligomeric substructures, wherein each oligomeric substructure comprises a plurality of recombinant polypeptides that self-interact around at least one axis of rotational symmetry, wherein
  (i) each of the recombinant polypeptides comprises a polypeptide-polypeptide interface ("O interface"):
  (ii) one or more of the recombinant polypeptides comprises a polypeptide domain that is capable of interacting with a lipid bilayer ("M domain");
  (iii) one or more of the recombinant polypeptides comprises a polypeptide domain that is capable of effecting membrane scission and release of an enveloped multimeric assembly from a cell by recruiting the ESCRT machinery to the site of budding by binding to one or more proteins in the eukaryotic ESCRT complex ("L domain"); and
  (iv) one or more of the recombinant polypeptides comprises an RNA binding domain ("RBD");
 wherein the M domain, the L domain, the O interface, and the RBD are not each present in a single naturally occurring protein; and
 (b) one or more active component selected from the group consisting of:
  (i) one or more RNAs encoding a DNA binding protein, including but not limited to a genome editing protein, that is capable of being bound by the RBD;
  (ii) one or more RNAs comprising
   (A) one or more guide RNA (gRNA), wherein each gRNA comprises (I) a guide sequence capable of binding to a desired nucleic acid sequence; (II) an RNA packaging sequence capable of being bound by the RBD; and (III) a structural sequence capable of binding to a Class 2 Cas protein to form a Class 2 Clustered regularly-interspaced short palindromic repeats (CRISPR)-Cas ribonucleoprotein (RNP) complex; and
   (B) one or more mRNA encoding a Class 2 Cas protein and an RNA packaging sequence capable of being bound by the RBD; and/or
  (iii) one or more Class 2 CRISPR-Cas RNP complexes comprising a Class 2 Cas protein and one or more gRNA bound by the Class 2 Cas protein, wherein each gRNA comprises (I) a guide sequence capable of binding to a desired nucleic acid sequence; (II) an RNA packaging sequence capable of being bound by the RBD; and (III) a structural sequence capable of binding to a Class 2 Cas protein.

Embodiments (b)(i), (b)(ii), and (b)(iii) may present/used alone or in combination in the compositions and methods disclosed herein.

The compositions of all aspects and embodiments of the disclosure can be used for delivering to a recipient cell an RNA encoding a DNA binding protein, an RNA encoding a Class 2 Cas protein, and/or a Class 2 Cas protein for any suitable purpose, including but not limited to gene editing, gene silencing, or gene activation of any suitable target DNA in the recipient cell. In one embodiment, the compositions can be used in the methods disclosed herein, in which it is surprisingly shown that the RNPs resulting from delivery of the compositions to a recipient cell will be released from multimeric assemblies and traffic to the nucleus after fusion with a recipient cell's endosomal membrane in an amount adequate to mediate efficient genome editing or gene regulation.

The compositions may be present, for example, in cells that express the one or more active component and the recombinant polypeptides that self-assemble into the multimeric assemblies. Alternatively, the compositions may be present, for example, as extracellular vesicles enveloped in a lipid bilayer (enveloped protein nanocage ("EPN")) after membrane scission is effected by recruiting the ESCRT machinery to the site of budding as described in detail below. The multimeric assemblies and the one or more active component of the compositions described herein may be separate entities, the one or more active component may be packaged in the multimeric assemblies, or both packaged and unpackaged (separate) embodiments may both be present within the compositions disclosed herein.

The compositions of the disclosure are synthetic, in that they are not naturally occurring. The recombinant polypeptides that make up the multimeric assembly are non-naturally occurring polypeptides that can be produced by any suitable means, including recombinant production or chemical synthesis. In this first aspect, each member of the plurality of recombinant polypeptides is identical to each other. There are no specific primary amino acid sequence requirements for the polypeptides. As described in detail herein, the inventors disclose methods for designing the compositions and multimeric assemblies of the disclosure, where the multimeric assemblies are not dependent on specific primary amino acid sequences of the recombinant polypeptides that make up the oligomeric substructures that interact to form the multimeric assemblies of the compositions. As will be understood by those of skill in the art, the design methods of the disclosure can produce a wide variety of compositions made of a wide variety of recombinant polypeptides, and the methods are in no way limited to the compositions and recombinant polypeptides disclosed herein.

As used herein, a "plurality" means at least two; in various embodiments, there are at least 2, 3, 4, 5, 6 or more recombinant polypeptides in the oligomeric substructures. In one exemplary embodiment, the oligomeric substructure comprises a trimer of the protein.

In one embodiment, 2, 3, 4, 5, 6, or more, or each of the recombinant polypeptides comprises an L domain. In another embodiment, 2, 3, 4, 5, 6, or more, or each of the recombinant polypeptides comprises an M domain. In a further embodiment, 2, 3, 4, 5, 6, or more, or each of the recombinant polypeptides comprises an RBD. Those of skill in the art will recognize that a variety of recombinant polypeptides may thus be present in the plurality of recombinant polypeptides, including polypeptides with only the O domain; polypeptides with an O domain and an M domain; polypeptides with an O domain, and M domain, and an L domain; polypeptides with an O domain and an L domain; polypeptides with an O domain and an RBD; polypeptides with an O domain, an L domain, and an RBD; etc.

The recombinant polypeptides of any aspect of the disclosure may be of any suitable length for a given purpose of the resulting compositions. In one embodiment, the recombinant polypeptide is typically between 30-500 amino acids in length. In various further embodiments, the protein is between 30-400, 30-300, 30-200, 30-175 50-400, 50-300, 50-200, 50-175, 75-400, 75-300, 75-200, 75-175, 100-400, 100-300, 100-200, 100-175, 125-400, 125-300, 125-200, 125-175, 150-400, 150-300, 150-200, and 150-175 amino acids in length.

The plurality of recombinant polypeptides self-interact to form an oligomeric substructure, where each oligomeric substructure may comprise at least one axis of rotational symmetry. As will be understood by those of skill in the art, the self-interaction is a non-covalent protein-protein interaction. Any suitable non-covalent interaction(s) can drive self-interaction of the recombinant polypeptides to form the oligomeric substructure, including but not limited to one or more of electrostatic interactions, it-effects, van der Waals forces, hydrogen bonding, and hydrophobic effects. The self-interaction in the oligomeric substructure may be natural or synthetic in origin; that is, the recombinant polypeptides making up the multimeric assemblies of the disclosure may be synthetic variations of natural proteins that self-interact to form oligomeric substructures, or they may be fully synthetic proteins that have no amino acid sequence relationships to known natural proteins.

As used herein, "at least one axis of rotational symmetry" means at least one axis of symmetry around which the oligomeric substructure can be rotated without changing the appearance of the substructure. In one embodiment, the oligomeric substructure has cyclic symmetry, meaning rotation about a single axis (for example, a three-fold axis in the case of a trimeric protein; generally, oligomeric substructures with n subunits and cyclic symmetry will have n-fold rotational symmetry, sometimes denoted as $C_n$ symmetry). In other embodiments, the oligomeric substructure possesses symmetries comprising multiple rotational symmetry axes, including but not limited to dihedral symmetry (cyclic symmetry plus an orthogonal two-fold rotational axis) and the cubic point group symmetries including tetrahedral, octahedral, and icosahedral point group symmetry (multiple kinds of rotational axes). In one non-limiting embodiment, the oligomeric substructure comprises a dimer, trimer, tetramer, or pentamer of the protein. In a further non-limiting embodiment, the oligomeric substructure comprises a trimeric protein.

In the multimeric assemblies of the disclosure, there are at least two identical copies of the oligomeric substructure. In general, the number of copies of the oligomeric substructure is dictated by the number of symmetry axes in the designated mathematical symmetry group of the multimeric assembly that matches the symmetry axes in each oligomeric substructure. This relationship arises from the requirement that the symmetry axes of each copy of the oligomeric substructure must be aligned to symmetry axes of the same kind in the multimeric assembly. By way of non-limiting example, a multimeric assembly with tetrahedral point group symmetry can comprise exactly four copies of a trimeric substructure aligned along the exactly four three-fold symmetry axes passing through the center and vertices of a tetrahedron. In general, although every copy of the oligomeric substructure may have its symmetry axes aligned to symmetry axes of the same kind in the multimeric assembly, not all symmetry axes in the multimeric assembly must have an oligomeric building block aligned to them. By way of non-limiting example, we can consider a multimeric assembly with icosahedral point group symmetry comprising multiple copies of the oligomeric substructure. There are 30 two-fold, 20 three-fold, and 12 five-fold rotational symmetry axes in icosahedral point group symmetry. The multimeric assemblies of the disclosure may be those in which the oligomeric substructures are aligned along all instances of one type of symmetry axes in a designated mathematical symmetry group. Therefore, the multimeric assemblies in this non-limiting example could include icosahedral nanostructures comprising 30 dimeric substructures, or 12 pentameric substructures, or 20 trimeric substructures. In each case, two of the three types of symmetry axes are left unoccupied by oligomeric substructures.

The interaction between the oligomeric substructures is a non-natural (e.g., not an interaction seen in a naturally occurring protein multimer), non-covalent interaction at the O interface; this can comprise any suitable non-covalent interaction(s), including but not limited to one or more of electrostatic interactions, π-effects, van der Waals forces, hydrogen bonding, and hydrophobic effects. The interaction may occur at multiple identical (i.e., symmetrically related) O interfaces between the oligomeric substructures, wherein the O interfaces can be continuous or discontinuous. This symmetric repetition of the O interfaces between the oligomeric substructures results from the overall symmetry of the multimeric assemblies; because each protein is in a symmetrically equivalent position in the multimeric assembly, the interactions between them are also symmetrically equivalent.

Non-covalent interactions between the oligomeric substructures may orient the substructures such that their symmetry axes are aligned with symmetry axes of the same kind in a designated mathematical symmetry group as described above. This feature provides for the formation of regular, defined multimeric assemblies, as opposed to irregular or imprecisely defined structures or aggregates. Several structural features of the non-covalent interactions between the oligomeric substructures may help to provide a specific orientation between substructures. Generally, large interfaces that are complementary both chemically and geometrically and comprise many individually weak atomic interactions tend to provide highly specific orientations between protein molecules. In one embodiment of the subject disclosure, therefore, each symmetrically repeated instance of the O interface between the oligomeric substructures may bury between 1000-2000 Å$^2$ of solvent-accessible surface area (SASA) on the combined oligomeric substructures. SASA is a standard measurement of the surface area of molecules commonly used by those skilled in the art; many computer programs exist that can calculate both SASA and the change in SASA upon burial of a given interface for a given protein structure. A commonly used measure of the geometrical complementarity of protein-protein interfaces is the Shape Complementarity (S$_c$) value of Lawrence and Colman (J. Mol. Biol. 234:946-50 (1993)). In a further embodiment, each symmetrically repeated O interface between the oligomeric substructures may have an S$_c$ value between 0.5-0.8. Finally, in order to provide a specific orientation between the oligomeric substructures, in many embodiments the O interface between them may be formed by relatively rigid portions of each of the protein. This feature ensures that flexibility within each protein molecule does not lead to imprecisely defined orientations between the oligomeric substructures. Secondary structures in proteins, that is alpha helices and beta strands, generally make a large number of atomic interactions with the rest of the protein structure and therefore occupy relatively rigidly fixed positions. Therefore, in one embodiment, at least 50% of the atomic contacts comprising each symmetrically repeated, O interface between the oligomeric substructures are formed from amino acid residues residing in elements of alpha helix and/or beta strand secondary structure.

The multimeric assemblies of all embodiments of the disclosure are capable of forming a variety of different structural classes based on the designated mathematical symmetry group of each assembly. As the teachings above indicate, the assemblies comprise multiple copies of substructures that interact at one or more O interfaces that orient the substructures such that their symmetry axes may align with symmetry axes of the same kind in a designated mathematical symmetry group. There are many symmetry groups that comprise multiple types of symmetry axes, including but not limited to dihedral symmetries, cubic point group symmetries, line or helical symmetries, plane or layer symmetries, and space group symmetries. Each individual assembly possesses a single, mathematically defined symmetry that results from the interface between the substructures orienting them such that their symmetry axes align to those in a designated mathematically symmetry group. Individual assemblies possessing different symmetries may find use in different applications; for instance, assemblies possessing cubic point group symmetries may form hollow shell- or cage-like structures that could be useful, for example, for packaging or encapsulating molecules of interest, while assemblies possessing plane group symmetries will tend to form regularly repeating two-dimensional protein layers that could be used, for example, to array molecules, nanostructures, or other functional elements of interest at regular intervals.

In one embodiment, the mathematical symmetry group is selected from the group consisting of tetrahedral point group symmetry, octahedral point group symmetry, and icosahedral point group symmetry.

The RNA binding domain ("RBD") may be any suitable polypeptide domain that is capable of binding to double- or single-stranded nucleic acid (such as ssRNA or dsRNA), including but not limited to RBDs comprising a RNA recognition motif, a dsRNA binding domain, zinc finger domain, etc. Each recombinant polypeptide that comprises an RBD may have any suitable number (1, 2, 3, 4, or more) of RBDs as deemed appropriate for a given use. The RBD component of the multimeric assemblies permits packaging of the active component in resulting assemblies, and permits use of the compositions for delivery of the active components to a recipient cell.

In various non-limiting embodiments, the RBD comprises or consists of the amino acid sequence selected from the group consisting of SEQ ID NOS: 198-201, and 330.

SEQ ID NO: 201
mnb RBD
RPRGTRGKGRRMR

SEQ ID NO: 198
1g70 RBD
DRRRRGSRPSGAERRRRRAAAA

SEQ ID NO: 200
HIV_NCRBD
MQKGNFRNQRKTVKCFNCGKEGHIAKNCRAPRKKGCWKCGKEGHQMKDC
TERQAN

SEQ ID NO: 199
u1a RBD
AVPETRPNHTIYINNLNEKIKKDELKKSLHAIFSRFGQILDILVSRSLKM
RGQAFVIFKEVSSATNALRSMQGFPFYDKPMRIQYAKTDSDIIAKMK

SEQ ID NO: 330
com RBD
KSIRCKNCNKLLFKADSFDHIEIRCPRCKRHIIMLNACEHPTEKHCGKRE
KITHSDETVRY In one aspect, the one or more active component comprises one or more RNAs encoding a DNA binding protein that is capable of being bound by the RBD. Any suitable RNA encoding a DNA binding protein of interest as the active component can be used in this embodiment, depending on the nucleic acid target in a recipient cell. Those of skill in the art are aware of many such DNA binding proteins. In various embodiments, the DNA binding protein may comprise a transcription activator, a transcription silencer, or a DNA editing protein, depending on the intended use of the compositions in the recipient cell. In various non-limiting embodiments, the one or more RNAs encoding a DNA binding protein are selected from the group consisting of RNAs encoding a zinc finger DNA binding protein, Transcription Activator-Like Effector (TALE) protein, meganuclease, recombinase, integrase, transposase, single-stranded DNA binding protein, and nucleotide-modifying protein. In another embodiment, the one or more RNAs encoding a DNA binding protein encode a protein exhibiting deaminase activity. In all of these embodiments, the RNA is capable of being bound by the RBD of the recombinant polypeptide/multimeric complexes, thus permitting the active component to be packaged in the multimeric assembly. In one embodiment, the RNA encoding a DNA binding protein is a recombinant RNA and comprises an RNA packaging sequence capable of being bound by the RBD. The RNA packaging sequence may be any RNA sequence capable of being bound by the RBD present in the multimeric assembly. In various embodiments, the RNA packaging sequence comprises or consists of a sequence that is at least 50%, 55%, 60%, 65%, 70%, 75%, 80%, 85%, 90%, 95%, 96%, 97%, 99%, or 100% identical over its length to the nucleic acid sequence selected from the group consisting of 204-207, and 329.

```
RNA packaging sequences:
                                            SEQ ID NO: 207
mnb RNA packaging (hairpin) sequence
GGCUCGUGUAGCUCAUUAGCUCCGAGCC SEQ ID NO: 204
1g70 RNA packaging (hairpin) sequence
GGUCUGGGCGCACUUCGGUGACGGUACAGGCC SEQ ID NO: 206
HIV_NC RNA packaging (hairpin) sequence
GGCGACUGGUGAGUACGCCAAAAUUUUGACUAGCGGAGGCUAG SEQ ID NO: 205
u1a RNA packaging (hairpin) sequence
AAUCCAUUGCACUCCGGAUUU SEQ ID NO: 329
com RNA packaging (hairpin) sequence
CUGAAUGCCUGCGAGCAUC
```

The RNA packaging sequence may be positioned within the recombinant RNA in any suitable position. In various embodiments, the RNA packaging sequence is located 5' to each RNA encoding a DNA binding protein, 3' to each RNA encoding a DNA binding protein, or both 5' and 3' to each RNA encoding a DNA binding protein.

In a second aspect, the one or more active component comprises:
(A) one or more gRNA, wherein each gRNA comprises (I) a guide sequence capable of binding to a desired nucleic acid sequence; (II) an RNA packaging sequence capable of being bound by the RBD; and (III) a structural sequence capable of binding to a Class 2 Cas protein to form a Class 2 CRISPR-Cas RNP complex; and (B) one or more mRNA encoding a Class 2 Cas protein and an RNA packaging sequence capable of being bound by the RBD.

In this second aspect, the composition (in use) results in the one or more gRNA and the one or more mRNA encoding a Class 2 Cas protein and an RNA packaging sequence capable of being bound by the RBD both being packaged in the multimeric assembly for delivery to a recipient cell, where the Class 2 Cas protein is translated and assembles with the gRNA to form an RNP complex that binds the desired nucleic acid (genomic DNA, episomal DNA, RNA, etc.) in the recipient cell to carry out the desired activity (gene editing, transcriptional activation, silencing, etc.)

In a third aspect, the one or more active component comprises one or more RNP complexes comprising a Class 2 Cas protein and one or more gRNA bound by the Class 2 Cas protein, wherein each gRNA comprises (I) a guide sequence capable of binding to a desired nucleic acid sequence; (II) an RNA packaging sequence capable of being bound by the RBD; and (III) a structural sequence capable of binding to a Class 2 Cas protein to form a Class 2 CRISPR-Cas RNP complex.

In this third aspect, the composition (in use) results in the one or more Class 2 Cas protein-gRNA RNP complexes being packaged in the multimeric assembly for delivery to a recipient cell, where the RNP complex is released from the multimeric assembly and then binds the desired nucleic acid (genomic DNA, episomal DNA, RNA, etc.) in the recipient cell to carry out the desired activity (gene editing, transcriptional activation, silencing, etc.)

In each of these second and third aspects, the term guide RNA (gRNA) is used to refer to any DNA-targeting RNA molecule that guides the Class 2 Cas protein to a specific nucleic acid sequence, such as a genomic or episomal sequence for gene editing or gene regulation. gRNA refers to all RNAs that guide Cas protein (e.g., Cas9) targeting, including tracrRNA, crRNAs, and single guide RNAs (sgRNAs).

In each of these second and third aspects, any suitable RNA packaging sequence may be used in the gRNAs. RNA packaging sequences are described above. In various embodiments, the RNA packaging sequence comprises or consists of a sequence that is at least 50%, 55%, 60%, 65%, 70%, 75%, 80%, 85%, 90%, 95%, 96%, 97%, 99%, or 100% identical over its length to the nucleic acid sequence selected from the group consisting of SEQ ID NOS: 204-207, and 329.

In each of these second and third aspects, the gRNA comprises a structural sequence, which is the sequence that is required for assembly with the Class 2 Cas protein to form the RNP. As used herein, "Class 2 Cas protein" means Cas (CRISPR-associated) proteins that use a single Cas protein to bind to DNA. Many such Class 2 Cas proteins and corresponding structural sequences are well known to those of skill in the art. The structural sequence for use in these aspects will depend on the specific Class 2 Cas protein that is either encoded by the mRNA (second aspect) or that is present in the RNP (third aspect). The specific Class 2 Cas protein, or mRNA encoding a Class 2 Cas protein, to be used can be determined by those of skill in the art based on the intended use of the composition. In one embodiment, the Class 2 Cas protein, or mRNA encoding a Class 2 Cas protein, comprises a Cas9 protein or mRNA encoding a Cas9 protein. In another embodiment, the Class 2 Cas protein, or mRNA encoding a Class 2 Cas protein, comprises a Cpf1 protein or mRNA encoding a Cpf1 protein. All Class 2 CRISPR-Cas systems could be used for nucleic acid binding, including applications in nucleic acid editing, degradation, or regulation. The CRISPR-Cas system may be chosen by those skilled in the art based on requirements of the specific sequence being targeted (differences in protospacer adjacent motif sequence), specificity requirements (some CRISPR-Cas systems exhibit greater specificity than others), immunogenicity (many humans have pre-existing immunity against some Cas proteins), etc.

In various embodiments of the second aspect, the mRNA encoding the Class 2 Cas protein comprises an mRNA encoding an amino acid sequence having at least 50%, 55%, 60%, 65%, 70%, 75%, 80%, 85%, 90%, 95%, 96%, 97%, 98%, 99%, or 100% identity along its full length to the amino acid sequence selected from the group consisting of SEQ ID NO: 367-372, or the amino acid sequence of a protein listed by Uniprot database accession number in Table 1.

TABLE 1

List of stable UniProt Entry IDs for Cas9 genes

Q99ZW2, A0Q5Y3, J7RUA5, G3ECR1, J3F2B0, C9X1G5, Q927P4, Q8DTE3, Q6NKI3, Q03J16,
A0A0U3M618, Q9CLT2, A1IQ68, Q0P897, A0A1V5TFK4, A0A142WV29, A0A0B8YC59,
A0A0F3H9Z9, A0A0J5P9G6, A0A1V6I2Y8, A0A1W6VMQ3, A0A151APJ0, A0A199XSD8,
A0A0F2E4R3, A0A0A1PPJ7, G9S0W2, Q03LF7, A0A1I2VQA1, A0A073IDR3, F5WVI4, E7FPD8,
A0A0B2JE32, F5WVJ4, A0A0U1CKT1, A0A1H0YAG6, T0HC86, A0A0F6X1U4, E9FJ16,
A0A0D0ZAW2, A0A0A8GXC3, A0A0H1A177, A0A2A4G547, A0A1I1J5W0, A0A139MDP4,
D7N6R3, A0A291DCL0, A0A1G6UPQ0, A0A139PB46, M3INT0, A0A1V0GJQ8, E8LGQ1,
A0A1H0K3Q5, A0A0P1D4L3, A0A081R6F9, U5Q7L9, A0A0W7V6X6, A0A1G9K5U8, R7DKC0,
A0A139NVJ1, A0A139NSX3, I8UMX3, A0A219D582, A0A1G5VTW4, A0A269YDW0,
A0A1F0BNE0, W0EYD8, A0A0U3BTM1, A0A1S6E9Z3, R7B4M2, A0A0D6ZH65,
A0A1X7GNL0, A0A242VGP4, A0A0R2HZC9, E2N8V1, A0A0R1KIP2, J2WFY6, K2PT21,
A0A0F6CLF2, F3PY63, B9M9X8, A0A134AG29, A0A0R0LIZ4, J4XAP6, A0A1M5S3A1,
A0A162UIU8, A0A0U5KB17, A0A1M4WUM9, A0A0F4LLE0, A0A1Q3QR27, A0A0K1KC97,
A0A0E2SQU9, A0A0I1P7F8, A0A1T4P2M3, R7K435, A0A172Q7S3, D6KPM9, R9LW52,
A0A1G9KG89, K6QJ37, A0A134A116, Q20XX4, A0A1E8VW53, A0A180FK19, A0A0H1GB76,
A0A2G3DL88, A0A1U9MIU6, A0A1G5Z8I3, G2KVM6, A0A1R0FA11, A0A1U9MD17,
A0A1A9E0X4, A0A0H1TNR9, A0A1T5IDW8, A0A1T5EVW3, R5CLM1, A0A1F0AZ94, I1A5G3,
A0A136KX11, A0A1I6SZS7, G4Q6A5, F7LUT7, A0A1G6A5G6, R6QL84, A0A0D6MWC5,
J5TNY4, A0A095ZV18, H1Z4Q9, A0A167Y4I1, A0A2G1YXF8, A0A2D4ZRZ3, A0A1E9EMZ9,
A0A180F6C8, U5CHH4, A0A2A4LRF7, A0A227JJ40, A0A1G2XND7, A0A246M6V3,
A0A1Q9YNK3, A0A0R2HM97, K6R5Z8, X8KGX3, S4EM46, R6VIK8, A0A1Q6S274,
A0A1Y0M0N8, A0A0J7I637, A0A246MW80, A0A1M7BN72, A0A1Q6IYF8, K4Q9P5,
A0A239AS63, A0A1X1HQZ5, A0A1X1HHH1, A0A125U9P9, A0A085ZZC2, A0A0R1RHH9,
A0A0F2D9H7, A0A268TAS3, A0A1S8GQ14, A0A1H1B5L8, A0A1L8PC30, A0A099UFG2,
A0A1F1GZW9, A0A1Z4BNN5, I0Q2W2, A0A0E9MLX9, A0A0E2T2C8, A0A2G2HAK5,
A0A095XEU7, A0A0R1ZP43, A0A1Q3YI24, A0A2B4RD43, A0A1H3IC10, A0A2A2I727,
A0A250F2V3, A0A0Q9CTQ5, S0FEG1, A0A0R1F6R4, A0A1E9CQT0, E0QLT3, A0A1G6VAS2,
L2LBP5, A0A0E2Q4M6, A0A2G2PGL0, I3TWJ0, A0A268TC11, A0A1G6J4N2, D1YP75,
A0A2G1YQL7, A0A250FIA9, A0A1S1F1A9, A0A0F0LIJ3, A0A160JE60, E0PEL3, U2XW20,
S8H4C8, A0A1L6H8N6, A0A1M6K1M4, A0A0N1DXX4, A0A0N1DVV7, A0A1A5VIM0,
R5GJ26, A0A226G1T5, C4VKS7, A0A078PYN7, A0A0K9XVX7, F4FTI2, E0NI75, A0A1I4YFQ5,
A0A199XS43, A0A2C1LP74, A0A1M6T7T8, R5Z1T6, A0A0F3FWK9, A0A1V1ULK1,
A0A255SLK8, E0F2V7, A0A2D5GZQ0, W4PHU4, A0A1H9RN44, A0A1U7CVV7, B1BZW1,
E8KVY4, E3CQK3, A0A0P6SHS4, A0A0K1NCD0, G8XA12, A0A2G1YQR5, A0A2G2CGB4,
A0A2A2TTU3, A0A0Z8LKF1, A0A0Z8GCN2, A0A257S724, A0A098LI38, A0A1I6RA22,
D3NT09, K0G350, A0A174HSW2, A0A1M4Z653, A0A0E2RF34, A0A151A3A4, W1SA26,
D6S374, A0A1L8RGR8, A0A143IWU4, A0A0M2FYH7, A0A1G9U2S5, A0A1V2UL94,
A0A1Y0DZ11, A0A0X8KN88, E0NB23, A0A250FAQ8, R6ACK8, R5BD80, F0PZE9,
A0A1B7ZF33, G8X9H3, A0A0R1SCA3, G4CMU0, A0A0X3ARL2, A0A1L8RHH1, A0A2G1BT32,
A0A173UVP4, F0ET08, S9BH16, A0A1S1DIH5, A0A1T5FIY9, F4GDP9, A0A0J8GDE4,
A0A0R2AFH9, D6E761, A0A1P8WMF3, A0A0R1TBK9, A0A0E2A7Q9, A0A1H6K5S2,
A0A249DF05, R5C8N0, A0A1M6ABV9, C5TLV5, A0A1Z5IWP7, A0A1J7VRF7, W8GN24,
A0A061CF22, A0A246ACT4, A0A133QVN1, A0A088RCP8, A0A1D2U437, U1GXL8, K0MXA7,
F9N0W8, A0A0D8BYB2, A0A0X3Y1U5, A0A1I5C4C7, A0A0R2FKF9, A0A0J6BUV9, E3ELL7,
U6RJS5, A0A1Y3WFC2, A0A0F5PGD0, A0A0A2EHM8, R5N3I1, A0A075SSB9, A0A0K1NMP1,
A0A069QG82, U2QKG2, R7HI23, A0A1B3MNX3, B4U3U9, A0A1J5ARW5, A0A1H9YMZ7,
A0A0D2SXK1, C7X9T0, A0A1Q6NHQ3, A0A1F6GB10, A0A091BWC6, Q1J6W2, A0A1F2Q2S4,
L1P954, A0A1H9NKH7, A0A2G1C4U8, A0A0H2UUA5, A0A250FPT9, A0A1G4XGL8, V8C5L2,
A0A1F3CPB3, A0A1E4DZC0, A0A1J4U4Q5, A0A255ZBW8, A0A1R4DXK6, A0A1S8P176,
F4AF10, G6CGE4, U2YFI6, G2Z1C1, A0A0R2JE56, A0A2G2MAV9, A0A133QT10,
A0A291C7D9, A0A094IFR2, A0A0X8G6A4, R7PQD7, A0A1F3ECF5, A0A1S1H849,
A0A1W5ZFX1, A0A1S8T4P5, U2LB41, A0A1F2PKY0, A0A1F0NL12, R7ZSP8, R4U4X0,
A0A1C0YPC7, A0A1Q2HM83, A0A1B9E9Q0, F9YQX1, M4V7E7, C4ZA16, A0A267LZI1,
A0A250ENI5, U7USL1, A0A0R1XK13, A0A1Y4MDC8, I2NMF2, A0A173R3H4, A0A1M6NSB0,
A0A1Z3W165, A0A0E4H4H8, A0A0R1SN52, D0W2Z9, R6P3Z6, A0A1M3K4Y4, A0A0P1ETF1,
T0TIZ2, C9RJP1, I0SS54, A0A0R2DGS6, A0A0F2DF30, A0A0R1IS26, A0A0R1FUZ5,
A0A1X1JP06, W6I595, F8LWC5, Q1QGC9, A0A0R1IXU4, A0A077KK20, A0A081Q0Q9,
A1WH93, A0A1H3A9U0, A0A1B3PSQ7, A0A1X0WXP0, A0A1X1GD62, A0A0F2DWP8,
A0A1X1G0J0, Q1JLZ6, A0A1X1GCS7, A0A1X1FQA2, A0A1Y4PQ68, J3JPT0, Q4A5I2,
A0A1I1D643, A0A1X0WR94, A0A1X1GV45, A0A1X1G1M7, A0A1X1FK70, Q48TU5,
A0A1S1XUZ9, A0A0D0IUN5, A0A0K8MQR7, A0A268U165, A0A2A4L9T5, I7L6U4,
A0A0R1V7X0, A0A137PP63, L1PRF6, A0A2A4NX11, A0A174QZZ8, A0A0M9VGT5, L1NKM1,
A0A159Z911, A0A242XNH2, A0A1G6UQK2, A0A259FFY7, F0P0P2, A0A0N0IXQ9,
A0A1Q6J021, A0A1I3B7H6, A0A1H0V2M0, A0A1H3KV61, K8Z8F3, A0A0R2JSC5,
A0A1H8C6J4, A0A1Z3HIB0, A0A0N8K819, A0A256WGV0, E5WV33, U2SSY7, A0A0H1SD28,

TABLE 1-continued

List of stable UniProt Entry IDs for Cas9 genes

I7QXF2, U2VD49, A0A1Y3A092, A0A1M7G2U1, A0A0H3XIZ0, J4TM44, A0A1F1HP65,
S9AZZ0, A0A1E9G6C3, A0A238UDY4, A0A1M6X7K4, A0A1E4APC4, A0A134CKK1,
A0A0N8VNG6, D6LEV9, A9DTN2, A0A139QZ91, A5Z395, A0A133XDM2, A0A1T4J7C2,
J3TRJ9, A0A1Z5H3Q2, W1X0M6, C2UN05, A0A142Y9A8, R6XMN7, A0A1V0PWS4,
A0A1M7ZMB1, A0A1F1HK79, A0A136MV65, C5ZYI3, A0A0N1BP15, I4A2W8, E1W6G3,
L0RWU5, H2A7K0, E3HCA8, F7UWL3, A0A161SK95, C7M7G9, R6TXG4, M4S2X5,
A0A1G9LGH9, A0A2A4GRU9, C5NZ04, A0A2A2AHF0, A0A060RE66, U2Y346, A0A134C5X2,
A0A100YPE0, R6ZCR1, A0A233VHR9, U2QLH7, A0A1I5DYI6, A0A243MDI9, R6TGN6,
A0A0A2F4C3, A0A255U5Q6, A0A142LIG4, B1SGF4, A0A127VAB0, A0A2A6EP65,
A0A0P7AYC1, D9PRA6, F0FD37, A0A1I5KFS4, J9E534, A0A1I2PT06, A0A0R1JG51,
A0A0P0N7J4, A0A239RMR5, R5QL13, A0A0F4LIJ0, I0SF74, C2G539, D1W1M7, A0A1M6VU50,
A0A1G5CTM2, A0A134AYY3, D1VXP4, A0A1I0C0G9, A0A0R1UKG9, A0A174P7Q9, F2NB82,
A0A2A4HAP5, A0A1S8KM94, A0A1Q6ES56, K1I305, A0A062XBE5, K0ZH11, V2Q0I9,
F5U0T2, A0A017N289, A0A221RUW5, A0A1B2A6P4, A0A143X3E0, K0XCK7, Q2RX87,
A0A1G3HQ03, R7BDB6, A0A168F6Q2, A0A0M4TTU2, A0A243PLX4, J4KDT3, A0A0N1BZF2,
A0A1P8RU91, A0A0N7KBI5, A0A1K1Q336, D5BR51, A0A174DF97, A0A087BJ94,
A0A0E1EMN2, A0A0H3GNI1, K6RXS8, A0A1M7EUE4, A0A1T5HTT8, A0A1C0BC24,
W4PXW0, A0A0R1MNC7, A0A1L6X2B0, A0A263HCH5, F9MP31, F9QBH3, K0NQV3,
A0A1E8GQ60, R7GMQ9, R5Z6B4, J0WLS6, D4J3S7, S0KIG9, A0A0K1W1S6, A0A1Y3ZBY1,
A0A128ECZ8, A0A1L9NYV2, A0A0R1MEL8, A0A2A7QQH1, A0A1E5KUU0, R5LWG1,
A0A0R1MEF5, A0A174HS76, A0A1A7NZJ6, A0A1H6S486, B0RZQ7, A0A1P8JCZ1,
A0A0P7L7M3, R5R3T7, A0A0Q6WIJ3, A0A0E9LLC5, A0A087N7M8, A0A1I7NCB5,
A0A0E9L8G0, A0A0D5BKQ5, A0A173V1H2, A0A1H7NG80, A0A1H6JZQ9, A0A251XZF7,
A0A0C9Q7U6, A0A1G0BIV7, A0A196P6K7, A0A1T1BSP9, A0A290UTX1, S9KSN8,
A0A0R1J9U0, A0A1Q2D5C5, F0Q2T1, A0A1H7WXF0, A0A1Q2D796, A9HKP2, K0ZVL9,
A0A1X6QNV8, A0A231V279, H8MA21, A0A1Y3UDH7, A0A0M1W3D2, A0A1L8XQG9,
A0A0R1ZCI7, A0A0R2KUQ3, A0A179EQS1, A0A249SGB5, A0A1U7ED34, A0A1H9L9V3,
U2DMI6, B5ZLK9, A0A1S1DBV4, G9QLF2, A0A0W7V0H0, A0A060RIR3, A0A1I7JPD5,
A0A1H3ZX83, I3C254, A0A1N7KTV9, A0A1C7DHH3, V5WGZ1, A0A139RFX7, Q5M542,
A0A1X1Q811, S6A330, R6DVD3, A0A0A1H768, A0A073IJU3, A0A1W9FM37, A0A1F0GAL4,
A0A1Y6JTP1, A0A0R2BKJ5, X8HGN9, A0A0N0CQ86, B7B6H7, A0A0R1LCE0, A0A0R2E213,
R5E349, A0A0F5ZHG0, Z4X329, R6V444, A0A1M5G4Q6, A0A134B2X0, R5WWQ0,
A0A139SZX8, A0A0R1QGB6, A0A1V2C2V0, A0A2A4H1S8, A8AY02, R5W806, A0A1P8JMN3,
A0A133QCR3, M2CG59, U6S081, A0A246EVB2, A0A1X6QP16, A0A1N7PGZ9, A0A1H9LFC7,
A0A0S3UL45, A0A1S1V9T5, A0A0R1RB53, A0A1E5TBF5, M2CIC2, A0A0R1SDU2, F3A050,
A0A1M6BW93, A0A136K613, A0A136K611, S1RM25, A0A0R1U8F5, A0A0R1S2S1,
A0A1S9D0F4, A0A0R2ERB4, A0A0E2M0A1, A0A136MGS3, A0A286RH95, A0A1T5BAU6,
A0A1T1ZTV0, A0A136K614, A0A0R1SG79, A0A1P8Q111, A0A1B3X857, A0A0R1LQW1,
F5S4M8, A0A248V845, A0A1S5WDD4, R6ZAM8, E1LI65, A0A0S8HUJ8, A0A0E1ENR2,
A0A239U749, A0A015Y7X0, A0A0R1RRH5, J9YH95, A0A0A1M6J2, A0A0H4LAU6,
A0A238NLC4, A0A078RYQ2, A0A1Q6MTC5, A0A174IBA6, A0A174GDD3, A0A1V8RJ55,
R6ET93, A0A1V0G6B2, D4KTZ0, A0A0T7L299, A0A1V3SQF1, A0A0E2EGB1, U7PCQ1,
A0A2A5L7R1, A0A1Y3YN68, M4R7E0, A0A0L6CQ85, A0A086AYB7, A0A1T4QZI2,
A0A1I5LXP1, U4TLD9, A0A059HXJ1, A0A0H0YP06, A0A1Q6LMR9, A0A0A0DHL5, H0UDA8,
A0A0A1VBC9, F9HIG7, A0A133YDF1, A0A285STC9, A0A1Y0VUB9, A0A0E1XG84, V5XLV7,
R5BQB0, A0A0E2EBU7, A0A0R1WWN2, A0A0Y5JFG8, A0A0Y6L5Q1, R6IUC1, K0ZI98,
H6PBR9, A0A133ZK65, A0A1I1RKT9, E4ZF34, A0A268TCF7, X5EPV9, A0A1G4WF58,
A0A0R2HDR9, G9RUL1, R7CVK2, E0PQK3, A0A143A550, A0A1Q6TH32, I4ZCD3,
A0A1G3AU21, A0A242X0I4, F2IKJ5, V9H606, A0A1G8KAU6, A0A1Z8PDK6, U2JCC9,
A0A081PRN2, A0A081Q742, A0A150NPH1, A0A1W6MJF1, A0A1W6BVC1, R6D2P4,
A0A246GHN0, E1VQA3, B8I085, S2WQ18, J2KJ07, A0A1X1K6S2, A0A133NAH6, I3Z8Z5,
A0A2D1UCV3, R5YTY1, Q1JH43, J0DFD8, A0A063YDU9, A0A1U7LAN8, F5X275, E6K6M2,
A0A1E5UGK6, E1WNY6, A0A1W6N6V9, A0A0C5WWB6, A0A1E5TL62, Q5L8F8,
A0A1V9B8M7, A0A0Q7HTH3, A0A0N1EBR4, A0A1C3SQ53, A0A1V9QLR1, S2KA46, D0DQ00,
D1JW17, R5MDQ9, A0A1Y3WYM8, A0A1G0ASG4, R5K6G6, F3ZS64, A0A1C0W3U5,
A0A1B3WEM9, A0A246G8C7, B1BJM3, A0A109Q6P7, A0A246GCC9, F9N3Y3, A0A0A8H849,
A0A0X8BZ89, A0A0R2N8E4, A0A1V2YU65, S8Q7K6, A0A1M6GJ07, A0A0F4LG72,
A0A1X1KW87, C6S593, A0A1H2XHZ8, A0A1Q3ZM17, A0A1H3Z5Q9, C9MPM6,
A0A240ALC9, A0A1U7DVQ4, A0A0F0L8Y7, A0A1H6GLU8, A0A1M7I5P1, A0A1Z5SJP7,
A0A0R2DR00, E7MR72, D1W6R4, A0A1F3K5N4, A0A1H7STE2, A0A0K2LF21, A0A1Y4GQJ9,
E1LBR5, A0A1Q6G4F5, A0A1F3JX82, A0A137SV51, A0A134BD56, A0A1M5JWT1,
A0A1F2HDH6, A0A0R1W1T1, R5JYM0, B1GZM3, A0A133YY65, F0I6Z8, A0A1W7QJZ4,
A0A0U1KQ91, J6LE60, S8FJS0, D5BC98, A0A2A4YP33, A0A270QEQ8, A0A101I188,
A0A2A5BK28, A0A0J5QZM1, A0A164D0W4, A0A1Q3RAA8, A0A166IG30, A0A1Q9MLU4,
A0A1Q8EAV4, A0A0A2YBT2, A0A1W9JKE2, A0A072ETA7, A0A0F0LWM6, E5V117,
A0A1R1I348, B6W3J8, J7M7J1, A0A264Y3N9, A0A1X3DJK4, A0A1H9APL9, A0A136MQ77,
A0A0F6SPN8, A0A243AJP8, S4ZP66, A0A0B4S2L0, A0A1M4T2N7, A0A097B2K6,
A0A1M3FTB9, A0A0T2NHL9, E6GPD8, M2SLU3, A0A1X8V944, A0A0R2CL57, A0A1X1IXG6,
A0A096B7Z5, A0A0U1QKL8, A0A1J6QGH8, A0A0G3EK96, A0A1J6PI62, A0A291U9W7,
A0A1X1IV62, S4NUM0, A0A1C2BS21, D3I574, K6BKD4, V5RIH2, A0A1N7HVP1, G6AFY6,
A0A254RZ19, A0A1S1FE71, D7N2B0, A7HP89, E6J3R0, A0A0A8HTA3, S1NSG8,
A0A132HQM8, D7JGI6, A0A2A4DVN9, K4I9M9, A0A1F1JMQ7, A0A0R2N0I6, R5SXF4,
A9M1K5, A0A1M5GNI9, A0A1Y4MYU4, K8MQ90, R6I3U9, W0Q6X6, S8QVE3, A0A1U9JTZ3,
A0A1E7PM50, S2D876, A0A218KZH0, R6E3D1, R7G6K2, A0A218KYI0, A0A0R2HIR8,
A0A242K0X1, A0A164BVA6, A0A1V8X815, L9PS87, A0A1S9CRA5, R5FTM9, A0A0R1TV35,
R0P7Y6, A0A1J6Q1Z5, A0A0B8Z713, U5ULJ7, A0A1F0HBZ7, A0A2A5BAH3, A0A267HTZ2,
A0A269ZJ58, A0A139BVD9, A0A162K701, A0A1Q9J389, A0A179YJ40, A0A1V5SJ19,
A0A1G2YSB5, A0A0B7IR20, A6VLA7, R5ZG15, W1R7X2, R5FLM1, A0A1G3GXD0,

TABLE 1-continued

List of stable UniProt Entry IDs for Cas9 genes

A0A116L128, A0A111NJ61, A0A1I0DP26, A0A134D9V8, J4K985, A0A116KAQ7,
A0A0Z8JWB5, C7XMU0, V6VHM9, A0A1I0CYR1, A0A1J5TRZ7, R5Y7W7, R6QHH1, T1ZF93,
A0A150MM34, A0A176I8B4, C9BHR2, T1DV82, A0A126UMM8, K2M2X7, A0A1V1REE0,
A0A087MCH0, A0A142WWG8, A6GZR9, A0A1I0EHL5, A0A259E5S9, I3DDB8, A0A116M370,
A0A0X1TKX4, A0A0U3EY47, S8FMU8, A0A163RXL7, A5KEK9, C0WE68, E1QW44,
A0A1Y2L5Z1, W0A9N2, A0A1J0A4R8, E8JP81, A0A291QSP8, Q7NAI2, A0A0V0PNI8,
A0A1Y5Z391, A0A1D3PTA0, C0FXH5, A0A1N7Q847, A0A150D6Y2, A0A1Y0TI38,
A0A1B2IXP8, A0A2A8E5Y7, Q7P7J1, A0A1H3WUW7, R7D1C6, A0A1Y0E5S8, A0A0Q4DTQ9,
A0A0U3F8P4, A0A178TEJ9, A0A0D8IYR9, A0A0R2KGU9, G9WGU4, A0A1L3KB40,
A0A164FEH7, W3XZF8, Q73QW6, F8Y040, A0A0J9G920, A0A0W7TPK7, A0A150MP45,
B1UZL4, A0A1S7DRB5, A0A0L8B0U9, E9S7M7, A0A015UZW6, I0AP30, A0A099UAI1,
H1DEI0, A0A1H6WDZ9, R8LDU5, A0A1M5BS28, A0A149VPM2, A0A0R2I8Q5, I0TCL1,
A0A1Q6FLZ7, A0A0G3MB19, A0A0H4KTI1, E0NJ84, A0A1V1YZY2, R7CG17, A0A178N1Y8,
W4T7U3, W3RQ02, A0A1M5J1T7, V8LSG7, V8LWT4, A0A1Q8RF43, A0A0F4LMR6,
A0A062TYY5, S3CB04, A0A1M5SB09, E7S4M3, A0A1X9T077, A0A1L8SVK0, R7KBA0,
A0A0J0YQ19, A0A1D8P523, Q7MRD3, R6U7U5, A0A202BVH2, A0A0C9MY24, A0A162CL99,
A0A1G3IFJ2, F9ZKQ5, S9APD1, A0A1X7Q6G9, S0RVL7, R5UJK1, A0A134A0B5,
A0A1E3KQ44, A0A1U9NI86, A0A250DVH8, A0A257QRD9, R7N9S8, A0A1K1NDA4,
A0A096AT21, E8TT22, I0X7Z6, A0A1B9A0Y5, D2EJF1, A0A136K955, S3KPV3, I1YU27,
D7IW96, Z4WS20, A0A1G0BAB7, A0A0F0KTR2, J9R1Q7, I9L4B5, W9EE99, A0A1G8GPA5,
F2B8K0, A0A1G6G0J4, A0A1Q9QGI8, A0A1I6UWB8, C9LGP5, A0A1Q8FD96, A0A1Q3M6H6,
S5ZZV3, A0A143DGZ8, A0A2D8Q851, A0A081BKX9, A0A2D8QFT9, A0A0K1P6G0,
A0A1I5V515, W7DKS7, A6BJV4, A0A239C9W9, A0A1I7IU82, A0A2A3N7Z4, F0RSV0,
A8REH9, A0A0C9PBG0, R5RU71, R5V4T4, A0A099BT78, A0A1G7DPY2, A0A0R2AL66,
A0A1Q6KZ42, A0A1Q6K968, A0A1Q9NZT8, A4K7Y9, A0A150J5Z8, A0A0P8AH74,
A0A0P7ZA83, Q5WR28, A0A125S8J8, A0A125S8L3, A0A1V6DGE5, A0A125S8K8,
A0A125S8M4, A0A125S8L2, A0A125S8I2, A0A125S8M5, A0A125S8J7, A0A125S8I9, C6SH44,
A0A0W8KZ82, A0A1C5P5Q5, A0A1V6IFI6, A0A1C9ZUE2, A0A2E0NZU0, A0A2G6DCB0,
A0A2H0GNK1, A0A1V5HJ02, A0A078MYF9, A0A0K8MIK7, A0A1V5RYW1, A0A2G9XWU8,
A0A1N6XQA1, A0A1V6G1Z0, A0A1V5TGV3, A0A125S8J9, A0A125S8M6, A0A125S8M2,
A0A125S8K1, A0A125S816, A0A125S8J5, A0A125S8K9, A0A125S8J3, A0A125S8L4,
A0A125S8L5, A0A125S8L8, A0A125S8I1, A0A125S8J1, A0A125S8L1, A0A125S8L7,
A0A125S8K2, A0A125S8I8, A0A125S8M0, A0A125S8K0, A0A125S8K7, A0A125S8J6,
A0A2A5F0Q1, A0A125S8L0, A0A125S8J2, A0A2G6IJ90, A0A1V6HA80, A0A2H0M4V6,
A0A2G6CFE9, A0A1V5MWK5, A0A1V6JGW0, A0A1E5ZAU0, A0A1V5N962, A0A1E7DWS8,
A0A1E8EI75, A0A1E6FAD7, A0A1E8EQS5, A0A1C9ZTA0, A0A1C9ZTA2, A0A1V5VZV2,
A0A250G7I7, A0A250EXV0, A0A2D7KK62, A0A250G4N4, A0A2G5WJG3, A0A2G4YRY6,
A0A1C6E673, A0A1T5D9T6, A0A1C6IPF7, A0A2D3PEA7, A0A261F7P4, A0A2D3PUG5,
A0A2D3NRF2, A0A1C4DJV4, A0A293NEG8, A0A1C6WUG4, A0A150H9Z2, A0A1V5LSU8,
A0A1Y2STF9, A0A2H0GJI9, A0A1K2I462, A0A1D9BML5, A0A1V6HJK9, A0A1D3QUT4,
A0A261F7M3, A0A2D3W5Y9, A0A0K8QW18, A0A2G6BUZ4, A0A1V5VT10, A0A2G6BX85,
A0A2E5UV52, A0A2G6C3Z5, A0A2G6C7J1, A0A2H0XL89, A0A0A8K7X7, A0A2G6LCU9,
A0A2H1EBI2, A0A125S8K3, A0A125S8I0, A0A125S8I4, A0A125S8I5, A0A125S8K6,
A0A125S8L9, A0A125S8L6, A0A125S8M1, A0A125S8J4, A0A125S8J0, A0A125S8M7,
A0A250KKH4, A0A125S8K4, A0A125S8M3, A0A2G6EZB8, A0A125S817, A0A125S813,
A0A125S8K5, A0A2E4PP62, F6ITQ2, A0A2D3NHS9, A0A2D3M501, A0A2D3LE86,
A0A2D3NBQ5, A0A2D3L7J5, A0A2G9IGK4, A0A2G6M090, A0A2G8I2W1, A0A2D3LIX5,
E0XXB7, A0A1C9ZT79, A0A2G8IAT9, A0A1Y4CJU7, A0A1C5U497, A0A2D9E0J1,
A0A1J5P0X9, A0A1J5Q6P6, A0A1J5RXK6, A0A1J5PDH9, A0A1J5RAD9, A0A1J5Q5D5,
A0A1J5SL12, A0A2G6PUR6, A0A1V5Z1M9, A0A2G6I0S9, A0A1J5JAU4, A0A2A5FIE9,
A0A1C6AKB3, A0A1C6BK34, A0A1V6BC58, A0A1C5TF27, A0A1V5LTC7, A0A2D2CYM2,
A0A2H0HHR1, A0A2H0IUF9, A0A2D2P7H6, C6SFU3, A0A212IVR1, A0A1V5YSA8,
A0A1D2LU44, A0A1D2JQJ5, A0A2A5DVK5, A0A2G9QU72, A0A2E1CU09, A0A2E1VQC6,
A0A2E2SL12, A0A143W8R3, A0A1V6B2C2, A0A2E1ELS2, A0A2D8RWN5, A0A173YKH0,
A0A1W7MBU9, G0M2G7, A0A2D3W5Y5, A0A1Q3UJV4, A0A1C5S579, A0A1V5PKA1,
A0A1V5QR12, A0A2G2IMU6, A0A285BZY5, A0A250EBH2, G1UFN3, G2ZYP2, A0A1H6BLP7,
A0A1C5L2R1, A0A2C8EL22, A0A1V5HLQ4, A0A1V5Y5R7, A0A1V5NU01, A0A1V5ZEY6,
A0A1V5RRJ8, A0A2E6KKX1, A0A2E2IZ53, A0A2D2NMI8, A0A1M5DU31, A0A1C5P2V8,
A0A1F0FMT7, A0A1V5PL73, A0A1V5PNM1, A0A2D2NVL8, A0A1Y3UKA7, A0A2D2P5D5,
A0A2D8C6E0, A0A222TD44, A0A1H5RY71, A0A1V5N287, A0A1V5L8V2, A0A1D2JYF3,
A0A1V5TPD2, A0A1V5G220, A0A1W6BMI2, A0A1V5ZX91, A0A1V6BFP8, A0A1V5QA97,
A0A2G9IMB3, A0A2D9B4B1, A0A1E9DYC7, A0A1Y4BLK7, A0A2E2W9J5, A0A1V6CPU4,
A0A2G5RNW2, A0A1S0Z5C3, A0A1V6BV74, A0A2G6LSW7, A0A2G2FGD1, A0A121IZ21,
A0A1V6DV06, A0A1V6DHD7, A0A2D3W0E2, A0A1M5X4B3, A0A1V4W9H8, A0A2H0G362,
A0A1V6JHW2, A0A1J4YC75, A0A2G7HDI4, A0A2E5F9I7, A0A1V5LIJ8, A0A1I4VGF9,
A0A0C9QP69, A0A1A9I5Z1, A0A257QCT7, A0A1V9F037, A0A174J8H3, A0A1M6ST31,
A0A173UDH4, E0Q490, A0A1B8ZVU5, A0A0R2CKA0, D2MWB9, D3UFL8, A0A1Y4IP47,
A0A0Q0YQ33, A0A292RW14, B5CL59, A0A1E9MP00, A0A1V2YSJ9, A0A0Q7WLY8,
A0A1V9U8D7, A0A0P7ZAL4, S0J9K5, S8HGI0, A0A268TNB5, A0A0D6THK4, A0A1F3KX15,
A0A1G8P2U6, U2LZE9, J4KB57, A0A0R1S4R8, A0A1H3WQM5, A0A255VIG5, A0A2G3NST7,
A0A175A1Y1, A0A1Y3S1F5, A0A1F0CFR4, A0A150XH78, S9BFF6, A0A1V3K2B7, R9I6A5,
E9DN79, A7H5P1, A0A1H6HKS8, A0A1I3ATB5, A0A1M7S3P9, A0A139NKI7, A0A0Q3K6A2,
G7SP82, A0A174NKB5, T5JDL4, A0A1H4RBZ7, A0A268U7Q9, A0A1Q3MYP8, I6T669,
A0A2A8BNK9, A0A0F0KRA2, A0A242JA34, V4Q7N5, A0A292RYC5, A0A1X1HCB9,
A0A115C375, A0A202FV25, A0A0H4LAX2, A0A1S2APE3, A0A174L7S6, A0A0H1UQ48,
A0A0H1UY93, A0A1B8J9V3, A0A116KLL2, A0A149MVX3, A0A2A2GRY8, A0A173WIE2,
A0A101CN94, A0A173VVZ1, A0A242IDM5, A0A1M4USV7, D5ESN1, X0QNI0, A0A1G8ESE5,
A0A1G0EQ52, A0A0F0KLI8, A0A0B7IQ14, A0A139NS17, A0A1A7KGF0, A0A0T0PVC7,

TABLE 1-continued

List of stable UniProt Entry IDs for Cas9 genes

A0A221RZN1, E9FPR9, A8LN05, J8VVI1, W8KE67, A0A1H4B7Y3, A0A060QC50,
A0A0A8GU36, A0A1H6QM3, A0A1E4MWW9, A0A1Q8QC83, A0A0D4CLL6, A0A140L0U7,
I0QHG7, A0A0J7IGI6, A0A0B7IB79, A0A0D7V4T2, D1AUW6, A0A1Y4G2J4, A0A0B6V308,
C5WH61, A0A1X7QJJ4, R7EW40, M4KKI8, A0A133Q212, Q8E042, U2U1P0, A0A1V0Q9X6,
K1LQN8, A0A0R1TGJ3, A0A0S2HX99, A0A0S2HWZ2, E5C8Y3, A0A233WAV8, A0A099TTS6,
T0TDV9, A0A0X7BAB3, A0A0B0BZE8, A0A1Y4M0G0, A0A2A5MA43, R7NZZ9, H3NQF8,
X5KBF9, V8BZU1, H3NFH0, U2KF13, A0A285TUA9, R7FJU9, R5J5B2, A0A140KZE5, I9J7D5,
A0A0R1K630, A0A0M2CKF7, A0A140L760, A0A0B2XHU2, C2D302, A0A0F2C996, W1U735,
E5CB73, A0A0M2H6R0, A0A1F0DMA4, A0A1C0B5Q4, A0A1G2Z7F6, A0A0A8HLU7,
A0A1D7ZZ65, A0A0T0M2G2, R6TGA0, A0A0E2EP65, A0A2D0A6F8, E3CY56, A0A1M3DXD8,
R8NC81, I7GTK8, A0A0C6FNA3, A0A250FZD3, S8QEL7, A0A1I4SB97, A0A1H6ZWH2,
J9W3C2, I8X6S1, A0A1A7V637, A0A134B453, A0A1I2A065, A0A1I1T9Q3, A0A239Y1P3,
A0A1Q3U0G6, A0A0F7K1T5, A0A1F0I0M2, A0A1I2J643, A0A1Q6HTX9, A0A0N8VZF6,
A0A1T4LEJ3, A0A163ZAI4, U2J559, U2IU08, R5YGP2, A0A0D6XNZ8, A0A0F6MNW4,
A0A1I2F0I4, A0A1F3JXQ4, A0A0M2HFX0, A0A089Y508, A0A143X9R5, A0A0A6Y3B0,
A0A0J6ZDQ5, C0WXA2, A0A0P6UDU2, A0A1W6LLZ3, A0A101CFI9, D0DRL9, A0A1I2Q529,
A0A1T4LZF3, A0A1A6FJT6, Q8E5R9, A0A1H2SUB6, A0A226HKT7, A0A0P6UEB3,
A0A249DIX4, A0A249DN25, J4XAC3, H7F839, A0A1W1YGR5, R9MHT9, A0A178KKP5,
A0A1X3DFB7, R0TXT9, A0A1B35LT6, W4P5R3, A0A1F3WWV3, F3UXG6, R7I2K1,
A0A125W407, A0A1M3PZ14, A0A096BCZ5, A0A1N7HXF3, A0A1R4JY54, C2M5N8,
A0A1J5EQ63, D7VKD0, S8HKH8, C7G697, A0A0N0CU60, A0A0R2DLB6, A0A014L746,
A0A1M5TZK3, A0A1C2D810, A0A235CQD2, A0A1L8WQK4, R7A6L3, R3WHR8,
A0A1Q6R559, W0SDH6, A0A0E3VRY2, A0A139DPY2, G5KAN2, Q13CC2, A0A1X6WKP1,
H1YII5, A0A0R2DIR3, A0A1F3L8V7, A0A135YMA6, A0A0E1ZJW4, A5EIM8, A0A1B9Y472,
A0A1F3LQ46, A0A1C2CVQ9, A0A0M3VQX7, N9WET2, A0A1I5WEN2, A0A268TSB0,
N9W911, F9Q210, A0A0P7LUX3, A0A1M6G068, A0A1E9H0Q4, A0A0R1M5J7, A0A133KEN0,
A0A097B8A9, A0A2G2BCZ8, A0A2G2B3A4, S3JXQ0, A0A1M3FC88, D6GRK4, C9BWE2,
I9UHX4, S4F007, A0A1M6BQU8, H7FYD8, A0A1M6HN92, A0A2B7ZXN0, F9DDR2,
A0A0E1ZMQ3, A0A0C3A2P0, A0A015UHU2, A0A0N0UTU1, A0A1T0B6J6, C5S1N0,
A0A173V977, A0A1G9C575, W3XVE3, A0A1Q6EKM0, A0A096D253, A3VED0, A0A015SZB2,
A0A0D0YUU5, G5JVJ9, A0A0M2HYF8, A0A0H3BZZ0, A0A1E7NLF1, A0A0M2USC9,
A0A0M2UQF4, A0A249N3Z0, A0A176TM67, A0A1I1AMI4, A0A0R1RFJ4, A0A017H668,
A0A0E2RG29, Q1WVK1, A0A1G9IV55, A0A1V0JEA8, U5P749, A0A1X7MXL1, A0A150HG44,
A0A076P3F6, A0A078PKP8, E7RR33, A0A069SLB0, A0A096CIC5, A0A1X7NTE6,
A0A0M4L2E7, B2KB46, R2S872, R2SDC4, A0A1M5L6E7, A0A0M4G8J7, K1M8Y6, S5R5C8,
A0A1Q353G3, F2C4I5, R5BUB1, Q6KIQ7, A0A1N6ED61, A3ZPG1, A0A1K1Q446,
A0A1X95VS1, J7TMY5, A0A1G0KS07, E6LI02, A0A174LFF7, A0A174PI34, F8LNX0, H1GG18,
A0A1R3T1W8, A0A085Z0I3, A0A1F1LKA7, A0A133YSB7, A0A134C7A8, A0A1N7BHN9,
W0EVM2, E1Z024, A0A176T602, A0A246EN17, A0A0U2W148, J8W240, A0A173SPI3,
A0A127TRM8, A0A136MB09, A0A0J1FEQ8, U2PI18, M4YX12, R5KSL2, E4MSY6, R7LEN0,
A0A1Q6UAM8, A0A1C7NZW8, A0A1V4SNM4, K1LM04, A0A0E3KNH9, A0A1X2ZB74,
C0WRP7, A0A1N6QTE6, A0A1T4RKA4, A0A0M7ERB3, A0A251YDA0, A0A251Z298,
A0A251XWS8, A0A251YF50, A0A1E4DUI9, A0A1G7D5N2, A0A1Y4CZX9, A0A1N7N3F4,
A0A1A9FXI0, A0A1J4V0P9, A0A0F4M7Y5, A0A1M4Z2G1, A0A1W7QE97, A0A223HP37,
A0A1F1B9V9, R5MT23, A0A0B7HB18, A0A1E4F4V8, W3Y2C1, A0A1N7IX34, A0A1Y3X8W7,
R5GUN8, A0A2A2A9T5, A0A1G2YVZ8, A0A0R2FVI8, C2CKI6, A0A2A4RKS7, R7D4J2,
A0A0C5JLX1, A0A251YMT9, A0A2A4KY29, G6B158, A0A1M7FGK0, E6WZS9, W1V0U5

---

In various embodiments of the third aspect, the Class 2 Cas protein comprises an amino acid sequence having at least 50%, 55%, 60%, 65%, 70%, 75%, 80%, 85%, 90%, 95%, 96%, 97%, 98%, 99%, or 100% identity along its full length to the amino acid sequence selected from the group consisting of SEQ ID NO: 367-372, or the amino acid sequence of a protein listed by Uniprot database accession number in Table 1. In one embodiment, the Class 2 Cas protein comprises, or the mRNA encoding the Class 2 Cas protein encodes a Class 2 Cas protein comprising an amino acid sequence having at least 50%, 55%, 60%, 65%, 70%, 75%, 80%, 85%, 90%, 95%, 96%, 97%, 98%, 99%, or 100% identity along its full length to the amino acid sequence selected from the group consisting of SEQ ID NO:367 (Sp Cas9), wherein changes from the amino acid sequence of SEQ ID NO:367 do not include changes at amino acid residues 10, 15, 66, 74, 78, 165, 762, 840, 854, 863, 982, 983, 986, 1125-1127, 1132, 1333-1335. In various further embodiments, changes from the amino acid sequence of SEQ ID NO:367 do not include changes at amino acid residues 97-150, 175-307, 312-409, and 475-477. In one embodiment, the Class 2 Cas protein comprises, or the mRNA encoding the Class 2 Cas protein encodes a Class 2 Cas protein comprising an amino acid sequence having at least 50%, 55%, 60%, 65%, 70%, 75%, 80%, 85%, 90%, 95%, 96%, 97%, 98%, 99%, or 100% identity along its full length to the amino acid sequence selected from the group consisting of SEQ ID NO: 370 (Sa Cas9), wherein changes from the amino acid sequence of SEQ ID NO: 370 do not include changes at amino acid residues 10, 477, 557, 580, 701, 704, 787, 985, 986, 991, 993, and 1015. In various further embodiments, changes from the amino acid sequence of SEQ ID NO:370 do not include changes at amino acid residues 97-150, 175-307, 312-409, and 475-477.

SEQ ID NO: 367
Cas9 Sp Cas9 protein
(M)DKKYSIGLDIGTNSVGWAVITDEYKVPSKKFKVLGNTDRHSIKKNLIGALLFDSG

ETAEATRLKRTARRYTRRKNRICYLQEIFSNEMAKVDDSFFHRLEESFLVEEDKKHE

-continued

RHPIFGNIVDEVAYHEKYPTIYHLRKKLVDSTDKADLRLIYLALAHMIKFRGHFLIEG

DLNPDNSDVDKLFIQLVQTYNQLFEENPINASGVDAKAILSARLSKSRRLENLIAQLP

GEKKNGLFGNLIALSLGLTPNFKSNFDLAEDAKLQLSKDTYDDDLDNLLAQIGDQYA

DLFLAAKNLSDAILLSDILRVNTEITKAPLSASMIKRYDEHHQDLTLLKALVRQQLPE

KYKEIFFDQSKNGYAGYIDGGASQEEFYKFIKPILEKMDGTEELLVKLNREDLLRKQR

TFDNGSIPHQIHLGELHAILRRQEDFYPFLKDNREKIEKILTFRIPYYVGPLARGNSRFA

WMTRKSEETITPWNFEEVVDKGASAQSFIERMTNFDKNLPNEKVLPKHSLLYEYFTV

YNELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSDGFANRNF

MQLIHDDSLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHPVENTQLQ

NEKLYLYYLQNGRDMYVDQELDINRLSDYDVDHIVPQSFLKDDSIDNKVLTRSDKN

RGKSDNVPSEEVVKKMKNYWRQLLNAKLITQRKFDNLTKAERGGLSELDKAGFIKR

QLVETRQITKHVAQILDSRMNTKYDENDKLIREVKVITLKSKLVSDFRKDFQFYKVR

EINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMP

QVNIVKKTEVQTGGFSKESILPKRNSDKLIARKKDWDPKKYGGFDSPTVAYSVLVVA

KVEKGKSKKLKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQLFVEQH

KHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD

SEQ ID NO: 368
rAPOBEC1-Cas9
(M)SSETGPVAVDPTLRRRIEPHEFEVFFDPRELRKETCLLYEINWGGRHSIWRHTSQN

TNKHVEVNFIEKFTTERYFCPNTRCSITWFLSWSPCGECSRAITEFLSRYPHVTLFIYIA

RLYHHADPRNRQGLRDLISSGVTIQIMTEQESGYCWRNFVNYSPSNEAHWPRYPHL

WVRLYVLELYCIILGLPPCLNILRRKQPQLTFFTIALQSCHYQRLPPHILWATGLKSGS

ETPGTSESATPESDKKYSIGLAIGTNSVGWAVITDEYKVPSKKFKVLGNTDRHSIKKN

LIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDNL

LAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLN

REDLLRKQRTFDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPNEKVLPKH

SLLYEYFTVYNELTKVKYVTEGMRKPAFLSGEQKKAIVDLLFKTNRKVTVKQLKED

YFKKIECFDSVEISGVEDRFNASLGTYHDLLKIIKDKDFLDNEENEDILEDIVLTLTLFE

DREMIEERLKTYAHLFDDKVMKQLKRRRYTGWGRLSRKLINGIRDKQSGKTILDFLK

SDGFANRNFMQLIHDDSLTFKEDIQKAQVSGQGDSLHEHIANLAGSPAIKKGILQTVK

```
VVDELVKVMGRHKPENIVIEMARENQTTQKGQKNSRERMKRIEEGIKELGSQILKEH

PVENTQLQNEKLYLYYLQNGRDMYVDQELDINRLSDYDVDHIVPQSFLKDDSIDNK

VLTRSDKNRGKSDNVPSEEVVKKMKNYWRQLLNAKLITQRKFDNLTKAERGGLSEL

DKAGFIKRQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRKMIAKS

EQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAY

SVLVVAKVEKGKSKKLKSVKELLGITIMERSSFEKNPIDFLEAKGYKEVKKDLIIKLPK

YSLFELENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQAENIIHLFTLT

NLGAPAAFKYFDTTIDRKRYTSTKEVLDATLIHQSITGLYETRIDLSQLGGD
```

SEQ ID NO: 369
rAPOBEC1-Cas9-UGI

```
(M)SSETGPVAVDPTLRRRIEPHEFEVFFDPRELRKETCLLYEINWGGRHSIWRHTSQN

TNKHVEVNFIEKFTTERYFCPNTRCSITWFLSWSPCGECSRAITEFLSRYPHVTLFIYIA

RLYHHADPRNRQGLRDLISSGVTIQIMTEQESGYCWRNFVNYSPSNEAHWPRYPHL

WVRLYVLELYCIILGLPPCLNILRRKQPQLTFFTIALQSCHYQRLPPHILWATGLKSGS

ETPGTSESATPESDKKYSIGLAIGTNSVGWAVITDEYKVPSKKFKVLGNTDRHSIKKN

LIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDNL

LAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLN

REDLLRKQRTFDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPNEKVLPKH

SLLYEYFTVYNELTKVKYVTEGMRKPAFLSGEQKKAIVDLLFKTNRKVTVKQLKED

YFKKIECFDSVEISGVEDRFNASLGTYHDLLKIIKDKDFLDNEENEDILEDIVLTLTLFE

DREMIEERLKTYAHLFDDKVMKQLKRRRYTGWGRLSRKLINGIRDKQSGKTILDFLK

SDGFANRNFMQLIHDDSLTFKEDIQKAQVSGQGDSLHEHIANLAGSPAIKKGILQTVK

VVDELVKVMGRHKPENIVIEMARENQTTQKGQKNSRERMKRIEEGIKELGSQILKEH

PVENTQLQNEKLYLYYLQNGRDMYVDQELDINRLSDYDVDHIVPQSFLKDDSIDNK

VLTRSDKNRGKSDNVPSEEVVKKMKNYWRQLLNAKLITQRKFDNLTKAERGGLSEL

DKAGFIKRQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRKMIAKS

EQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAY

SVLVVAKVEKGKSKKLKSVKELLGITIMERSSFEKNPIDFLEAKGYKEVKKDLIIKLPK

YSLFELENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQAENIIHLFTLT

NLGAPAAFKYFDTTIDRKRYTSTKEVLDATLIHQSITGLYETRIDLSQLGGDSGGSTNL
```

-continued

SDIIEKETGKQLVIQESILMLPEEVEEVIGNKPESDILVHTAYDESTDENVMLLTSDAPE

YKPWALVIQDSNGENKIKMLS

SEQ ID NO: 370
Sa Cas9 protein sequence
KRNYILGLDIGITSVGYGIIDYETRDVIDAGVRLFKEANVENNEGRRSKRGARRLKRR

RRHRIQRVKKLLFDYNLLTDHSELSGINPYEARVKGLSQKLSEEEFSAALLHLAKRRG

VHNVNEVEEDTGNELSTKEQISRNSKALEEKYVAELQLERLKKDGEVRGSINRFKTS

DYVKEAKQLLKVQKAYHQLDQSFIDTYIDLLETRRTYYEGPGEGSPFGWKDIKEWY

EMLMGHCTYFPEELRSVKYAYNADLYNALNDLNNLVITRDENEKLEYYEKFQIIENV

FKQKKKPTLKQIAKEILVNEEDIKGYRVTSTGKPEFTNLKVYHDIKDITARKEIIENAE

LLDQIAKILTIYQSSEDIQEELTNLNSELTQEEIEQISNLKGYTGTHNLSLKAINLILDEL

WHTNDNQIAIFNRLKLVPKKVDLSQQKEIPTTLVDDFILSPVVKRSFIQSIKVINAIIKK

YGLPNDIIIELAREKNSKDAQKMINEMQKRNRQTNERIEEIIRTTGKENAKYLIEKIKL

HDMQEGKCLYSLEAIPLEDLLNNPFNYEVDHIIPRSVSFDNSFNNKVLVKQEENSKKG

NRTPFQYLSSSDSKISYETFKKHILNLAKGKGRISKTKKEYLLEERDINRFSVQKDFIN

RNLVDTRYATRGLMNLLRSYFRVNNLDVKVKSINGGFTSFLRRKWKFKKERNKGYK

HHAEDALIIANADFIFKEWKKLDKAKKVMENQMFEEKQAESMPEIETEQEYKEIFITP

HQIKHIKDFKDYKYSHRVDKKPNRELINDTLYSTRKDDKGNTLIVNNLNGLYDKDN

DKLKKLINKSPEKLLMYHHDPQTYQKLKLIMEQYGDEKNPLYKYYEETGNYLTKYS

KKDNGPVIKKIKYYGNKLNAHLDITDDYPNSRNKVVKLSLKPYRFDVYLDNGVYKF

VTVKNLDVIKKENYYEVNSKCYEEAKKLKKISNQAEFIASFYNNDLIKINGELYRVIG

VNNDLLNRIEVNMIDITYREYLENMNDKRPPRIIKTIASKTQSIKKYSTDILGNLYEVK

SKKHPQIIKKG

SEQ ID NO: 371
Lachnospiraceae bacterium Cpf1 (LbCpf1)
AASKLEKFTNCYSLSKTLRFKAIPVGKTQENIDNKRLLVEDEKRAEDYKGVKKLLDR

YYLSFINDVLHSIKLKNLNNYISLFRKKTRTEKENKELENLEINLRKEIAKAFKGAAGY

KSLFKKDIIETILPEAADDKDEIALVNSFNGFTTAFTGFFDNRENMFSEEAKSTSIAFRC

INENLTRYISNMDIFEKVDAIFDKHEVQEIKEKILNSDYDVEDFFEGEFFNFVLTQEGID

VYNAIIGGFVTESGEKIKGLNEYINLYNAKTKQALPKFKPLYKQVLSDRESLSFYGEG

YTSDEEVLEVFRNTLNKNSEIFSSIKKLEKLFKNFDEYSSAGIFVKNGPAISTISKDIFGE

WNLIRDKWNAEYDDIHLKKKAVVTEKYEDDRRKSFKKIGSFSLEQLQEYADADLSV

VEKLKEIIIQKVDEIYKVYGSSEKLFDADFVLEKSLKKNDAVVAIMKDLLDSVKSFEN

YIKAFFGEGKETNRDESFYGDFVLAYDILLKVDHIYDAIRNYVTQKPYSKDKFKLYFQ

NPQFMGGWDKDKETDYRATILRYGSKYYLAIMDKKYAKCLQKIDKDDVNGNYEKI

NYKLLPGPNKMLPKVFFSKKWMAYYNPSEDIQKIYKNGTFKKGDMFNLNDCHKLID

FFKDSISRYPKWSNAYDFNFSETEKYKDIAGFYREVEEQGYKVSFESASKKEVDKLV

EEGKLYMFQIYNKDFSDKSHGTPNLHTMYFKLLFDENNHGQIRLSGGAELFMRRASL

KKEELVVHPANSPIANKNPDNPKKTTTLSYDVYKDKRFSEDQYELHIPIAINKCPKNIF

KINTEVRVLLKHDDNPYVIGIDRGERNLLYIVVVDGKGNIVEQYSLNEIINNFNGIRIK

TDYHSLLDKKEKERFEARQNWTSIENIKELKAGYISQVVHKICELVEKYDAVIALEDL

NSGFKNSRVKVEKQVYQKFEKMLIDKLNYMVDKKSNPCATGGALKGYQITNKFESF

-continued

KSMSTQNGFIFYIPAWLTSKIDPSTGFVNLLKTKYTSIADSKKFISSFDRIMYVPEEDLF

EFALDYKNFSRTDADYIKKWKLYSYGNRIRIFAAAKKNNVFAWEEVCLTSAYKELF

NKYGINYQQGDIRALLCEQSDKAFYSSFMALMSLMLQMRNSITGRTDVDFLISPVKN

SDGIFYDSRNYEAQENAILPKNADANGAYNIARKVLWAIGQFKKAEDEKLDKVKIAI

SNKEWLEYAQTSVK

SEQ ID NO: 372
*Acidaminococcus sp.* BV3L6 Cpf1 (AsCpf1)
(M)TQFEGFTNLYQVSKTLRFELIPQGKTLKHIQEQGFIEEDKARNDHYKELKPIIDRIY

KTYADQCLQLVQLDWENLSAAIDSYRKEKTEETRNALIEEQATYRNAIHDYFIGRTD

NLTDAINKRHAEIYKGLFKAELFNGKVLKQLGTVTTTEHENALLRSFDKFTTYFSGFY

ENRKNVFSAEDISTAIPHRIVQDNFPKFKENCHIFTRLITAVPSLREHFENVKKAIGIFV

STSIEEVFSFPFYNQLLTQTQIDLYNQLLGGISREAGTEKIKGLNEVLNLAIQKNDETA

HIIASLPHRFIPLFKQILSDRNTLSFILEEFKSDEEVIQSFCKYKTLLRNENVLETAEALF

NELNSIDLTHIFISHKKLETISSALCDHWDTLRNALYERRISELTGKITKSAKEKVQRSL

KHEDINLQEIISAAGKELSEAFKQKTSEILSHAHAALDQPLPTTLKKQEEKEILKSQLD

SLLGLYHLLDWFAVDESNEVDPEFSARLTGIKLEMEPSLSFYNKARNYATKKPYSVE

KFKLNFQMPTLASGWDVNKEKNNGAILFVKNGLYYLGIMPKQKGRYKALSFEPTEK

TSEGFDKMYYDYFPDAAKMIPKCSTQLKAVTAHFQTHTTPILLSNNFIEPLEITKEIYD

LNNPEKEPKKFQTAYAKKTGDQKGYREALCKWIDFTRDFLSKYTKTTSIDLSSLRPSS

QYKDLGEYYAELNPLLYHISFQRIAEKEIMDAVETGKLYLFQIYNKDFAKGHEIGKPN

LHTLYWTGLFSPENLAKTSIKLNGQAELFYRPKSRMKRMAHRLGEKMLNKKLKDQK

TPIPDTLYQELYDYVNHRLSHDLSDEARALLPNVITKEVSHEIIKDRRFTSDKFFFHVPI

TLNYQAANSPSKFNQRVNAYLKEHPETPIIGIDRGERNLIYITVIDSTGKILEQRSLNTI

QQFDYQKKLDNREKERVAARQAWSVVGTIKDLKQGYLSQVIHEIVDLMIHYQAVVV

LENLNFGFKSKRTGIAEKAVYQQFEKMLIDKLNCLVLKDYPAEKVGGVLNPYQLTD

QFTSFAKMGTQSGFLFYVPAPYTSKIDPLTGFVDPFVWKTIKNHESRKHFLEGFDFLH

YDVKTGDFILHFKMNRNLSFQRGLPGFMPAWDIVFEKNETQFDAKGTPFIAGKRIVP

VIENHRFTGRYRDLYPANELIALLEEKGIVFRDGSNILPKLLENDDSHAIDTMVALIRS

VLQMRNSNAATGEDYINSPVRDLNGVCFDSRFQNPEWPMDADANGAYHIALKGQL

LLNHLKESKDLKLQNGISNQDWLAYIQELRN

In various further embodiments of the second aspect, the mRNA encoding a Class 2 Cas protein comprises a nucleotide sequence having at least 50%, 55%, 60%, 65%, 70%, 75%, 80%, 85%, 90%, 95%, 96%, 97%, 98%, 99%, or 100% identity along its full length to the nucleic acid sequence selected from the group consisting of SEQ ID NO: 373-378, and YY. In these sequences:

RNA packaging sequences (underlined)
(Optional WPRE stability sequence) (bold font)
(Optional Nuclear Localization Sequence) (italicized)
(Optional Western blot epitope) (underlined and bold font)
(Optional spacer sequence) (underlined and italicized)
(Optional RT-qPCr primer region) (italicized and bold font)

Sp Cas9 (without the surrounding optional sequences) =
SEQ ID 373
GGUAUCCACGGAGUCCCAGCAGCCGACAAGAAGUACAGCAUCGGCCUGGACAUCGGCA

CCAACUCUGUGGGCUGGGCCGUGAUCACCGACGAGUACAAGGUGCCCAGCAAGAAAUU

CAAGGUGCUGGGCAACACCGACCGGCACAGCAUCAAGAAGAACCUGAUCGGAGCCCUG

CUGUUCGACAGCGGCGAAACAGCCGAGGCCACCCGGCUGAAGAGAACCGCCAGAAGAA

GAUACACCAGACGGAAGAACCGGAUCUGCUAUCUGCAAGAGAUCUUCAGCAACGAGA

-continued

```
UGGCCAAGGUGGACGACAGCUUCUUCCACAGACUGGAAGAGUCCUUCCUGGUGGAAG

AGGAUAAGAAGCACGAGCGGCACCCCAUCUUCGGCAACAUCGUGGACGAGGUGGCCUA

CCACGAGAAGUACCCCACCAUCUACCACCUGAGAAAGAAACUGGUGGACAGCACCGAC

AAGGCCGACCUGCGGCUGAUCUAUCUGGCCCUGGCCCACAUGAUCAAGUUCCGGGGCC

ACUUCCUGAUCGAGGGCGACCUGAACCCCGACAACAGCGACGUGGACAAGCUGUUCAU

CCAGCUGGUGCAGACCUACAACCAGCUGUUCGAGGAAAACCCCAUCAACGCCAGCGGC

GUGGACGCCAAGGCCAUCCUGUCUGCCAGACUGAGCAAGAGCAGACGGCUGGAAAAUC

UGAUCGCCCAGCUGCCCGGCGAGAAGAAGAAUGGCCUGUUCGGAAACCUGAUUGCCCU

GAGCCUGGGCCUGACCCCCAACUUCAAGAGCAACUUCGACCUGGCCGAGGAUGCCAAA

CUGCAGCUGAGCAAGGACACCUACGACGACGACCUGGACAACCUGCUGGCCCAGAUCG

GCGACCAGUACGCCGACCUGUUUCUGGCCGCCAAGAACCUGUCCGACGCCAUCCUGCU

GAGCGACAUCCUGAGAGUGAACACCGAGAUCACCAAGGCCCCCCUGAGCGCCUCUAUG

AUCAAGAGAUACGACGAGCACCACCAGGACCUGACCCUGCUGAAAGCUCUCGUGCGGC

AGCAGCUGCCUGAGAAGUACAAAGAGAUUUUCUUCGACCAGAGCAAGAACGGCUACG

CCGGCUACAUUGACGGCGGAGCCAGCCAGGAAGAGUUCUACAAGUUCAUCAAGCCCAU

CCUGGAAAAGAUGGACGGCACCGAGGAACUGCUCGUGAAGCUGAACAGAGAGGACCU

GCUGCGGAAGCAGCGGACCUUCGACAACGGCAGCAUCCCCCACCAGAUCCACCUGGGA

GAGCUGCACGCCAUUCUGCGGCGGCAGGAAGAUUUUUACCCAUUCCUGAAGGACAACC

GGGAAAAGAUCGAGAAGAUCCUGACCUUCCGCAUCCCCUACUACGUGGGCCCCUCUGGC

CAGGGGAAACAGCAGAUUCGCCUGGAUGACCAGAAAGAGCGAGGAAACCAUCACCCCC

UGGAACUUCGAGGAAGUGGUGGACAAGGGCGCUUCCGCCCAGAGCUUCAUCGAGCGG

AUGACCAACUUCGAUAAGAACCUGCCCAACGAGAAGGUGCUGCCCAAGCACAGCCUGC

UGUACGAGUACUUCACCGUGUAUAACGAGCUGACCAAAGUGAAAUACGUGACCGAGG

GAAUGAGAAAGCCCGCCUUCCUGAGCGGCGAGCAGAAAAAGGCCAUCGUGGACCUGCU

GUUCAAGACCAACCGGAAAGUGACCGUGAAGCAGCUGAAAGAGGACUACUUCAAGAA

AAUCGAGUGCUUCGACUCCGUGGAAAUCUCCGGCGUGGAAGAUCGGUUCAACGCCUCC

CUGGGCACAUACCACGAUCUGCUGAAAAUUAUCAAGGACAAGGACUUCCUGGACAAU

GAGGAAAACGAGGACAUUCUGGAAGAUAUCGUGCUGACCCUGACACUGUUUGAGGAC

AGAGAGAUGAUCGAGGAACGGCUGAAAACCUAUGCCCACCUGUUCGACGACAAAGUG

AUGAAGCAGCUGAAGCGGCGGAGAUACACCGGCUGGGGCAGGCUGAGCCGGAAGCUG

AUCAACGGCAUCCGGGACAAGCAGUCCGGCAAGACAAUCCUGGAUUUCCUGAAGUCCG

ACGGCUUCGCCAACAGAAACUUCAUGCAGCUGAUCCACGACGACAGCCUGACCUUUAA

AGAGGACAUCCAGAAAGCCCAGGUGUCCGGCCAGGGCGAUAGCCUGCACGAGCACAUU

GCCAAUCUGGCCGGCAGCCCCGCCAUUAAGAAGGGCAUCCUGCAGACAGUGAAGGUGG

UGGACGAGCUCGUGAAAGUGAUGGGCCGGCACAAGCCCGAGAACAUCGUGAUCGAAA

UGGCCAGAGAGAACCAGACCACCCAGAAGGGACAGAAGAACAGCCGCGAGAGAAUGA

AGCGGAUCGAAGAGGGCAUCAAAGAGCUGGGCAGCCAGAUCCUGAAAGAACACCCCG

UGGAAAACACCCAGCUGCAGAACGAGAAGCUGUACCUGUACUACCUGCAGAAUGGGC

GGGAUAUGUACGUGGACCAGGAACUGGACAUCAACCGGCUGUCCGACUACGAUGUGG

ACCAUAUCGUGCCUCAGAGCUUUCUGAAGGACGACUCCAUCGACAACAAGGUGCUGAC
```

-continued

```
CAGAAGCGACAAGAACCGGGGCAAGAGCGACAACGUGCCCUCCGAAGAGGUCGUGAA

GAAGAUGAAGAACUACUGGCGGCAGCUGCUGAACGCCAAGCUGAUUACCCAGAGAAA

GUUCGACAAUCUGACCAAGGCCGAGAGAGGCGGCCUGAGCGAACUGGAUAAGGCCGG

CUUCAUCAAGAGACAGCUGGUGGAAACCCGGCAGAUCACAAAGCACGUGGCACAGAUC

CUGGACUCCCGGAUGAACACUAAGUACGACGAGAAUGACAAGCUGAUCCGGGAAGUG

AAAGUGAUCACCCUGAAGUCCAAGCUGGUGUCCGAUUUCCGGAAGGAUUUCCAGUUU

UACAAAGUGCGCGAGAUCAACAACUACCACCACGCCCACGACGCCUACCUGAACGCCG

UCGUGGGAACCGCCCUGAUCAAAAAGUACCCUAAGCUGGAAAGCGAGUUCGUGUACG

GCGACUACAAGGUGUACGACGUGCGGAAGAUGAUCGCCAAGAGCGAGCAGGAAAUCG

GCAAGGCUACCGCCAAGUACUUCUUCUACAGCAACAUCAUGAACUUUUUCAAGACCGA

GAUUACCCUGGCCAACGGCGAGAUCCGGAAGCGGCCUCUGAUCGAGACAAACGGCGAA

ACCGGGGAGAUCGUGUGGGAUAAGGGCCGGGAUUUUGCCACCGUGCGGAAAGUGCUG

AGCAUGCCCCAAGUGAAUAUCGUGAAAAAGACCGAGGUGCAGACAGGCGGCUUCAGC

AAAGAGUCUAUCCUGCCCAAGAGGAACAGCGAUAAGCUGAUCGCCAGAAAGAAGGAC

UGGGACCCCUAAGAAGUACGGCGGCUUCGACAGCCCCACCGUGGCCUAUUCUGUGCUGG

UGGUGGCCAAAGUGGAAAAGGGCAAGUCCAAGAAACUGAAGAGUGUGAAAGAGCUGC

UGGGGAUCACCAUCAUGGAAAGAAGCAGCUUCGAGAAGAAUCCCAUCGACUUUCUGG

AAGCCAAGGGCUACAAAGAAGUGAAAAAGGACCUGAUCAUCAAGCUGCCUAAGUACU

CCCUGUUCGAGCUGGAAAACGGCCGGAAGAGAAUGCUGGCCUCUGCCGGCGAACUGCA

GAAGGGAAACGAACUGGCCCUGCCCUCCAAAUAUGUGAACUUCCUGUACCUGGCCAGC

CACUAUGAGAAGCUGAAGGGCUCCCCCGAGGAUAAUGAGCAGAAACAGCUGUUUGUG

GAACAGCACAAGCACUACCUGGACGAGAUCAUCGAGCAGAUCAGCGAGUUCUCCAAGA

GAGUGAUCCUGGCCGACGCUAAUCUGGACAAAGUGCUGUCCGCCUACAACAAGCACCG

GGAUAAGCCCAUCAGAGAGCAGGCCGAGAAUAUCAUCCACCUGUUUACCCUGACCAAU

CUGGGAGCCCCUGCCGCCUUCAAGUACUUUGACACCACCAUCGACCGGAAGAGGUACA

CCAGCACCAAAGAGGUGCUGGACGCCACCCUGAUCCACCAGAGCAUCACCGGCCUGUA

CGAGACACGGAUCGACCUGUCUCAGCUGGGAGGCGAC
```

SEQ ID NO: 374

FLAG-Cas9-1g70_WPRE
GGUCUGGGCGCACUUCGGUGACGGUACAGGCC (*UAGGAUUACUGCUCGGUGACUUAUA*

*AUCAUCCUCCCCGCCACC*<u>AUGGACUAUAAGGACCACGACGGAGACUACAAGGAUCAU</u>

<u>GAUAUUGAUUACAAAGACGAUGACGAUAAG</u>*AUGGCCCCAAAGAAGAAGCGGAAGGUC*)

GGUAUCCACGGAGUCCCAGCAGCCGACAAGAAGUACAGCAUCGGCCUGGACAUCGGCA

CCAACUCUGUGGGCUGGGCCGUGAUCACCGACGAGUACAAGGUGCCCAGCAAGAAAUU

CAAGGUGCUGGGCAACACCGACCGGCACAGCAUCAAGAAGAACCUGAUCGGAGCCCUG

CUGUUCGACAGCGGCGAAACAGCCGAGGCCACCCGGCUGAAGAGAACCGCCAGAAGAA

GAUACACCAGACGGAAGAACCGGAUCUGCUAUCUGCAAGAGAUCUUCAGCAACGAGA

UGGCCAAGGUGGACGACAGCUUCUUCCACAGACUGGAAGAGUCCUUCCUGGUGGAAG

AGGAUAAGAAGCACGAGCGGCACCCCAUCUUCGGCAACAUCGUGGACGAGGUGGCCUA

CCACGAGAAGUACCCCACCAUCUACCACCUGAGAAAGAAACUGGUGGACAGCACCGAC

AAGGCCGACCUGCGGCUGAUCUAUCUGGCCCUGGCCCACAUGAUCAAGUUCCGGGGCC

ACUUCCUGAUCGAGGGCGACCUGAACCCCGACAACAGCGACGUGGACAAGCUGUUCAU

-continued

```
CCAGCUGGUGCAGACCUACAACCAGCUGUUCGAGGAAAACCCCAUCAACGCCAGCGGC
GUGGACGCCAAGGCCAUCCUGUCUGCCAGACUGAGCAAGAGCAGACGGCUGGAAAAUC
UGAUCGCCCAGCUGCCCGGCGAGAAGAAGAAUGGCCUGUUCGGAAACCUGAUUGCCCU
GAGCCUGGGCCUGACCCCCAACUUCAAGAGCAACUUCGACCUGGCCGAGGAUGCCAAA
CUGCAGCUGAGCAAGGACACCUACGACGACGACCUGGACAACCUGCUGGCCCAGAUCG
GCGACCAGUACGCCGACCUGUUUCUGGCCGCCAAGAACCUGUCCGACGCCAUCCUGCU
GAGCGACAUCCUGAGAGUGAACACCGAGAUCACCAAGGCCCCCCUGAGCGCCUCUAUG
AUCAAGAGAUACGACGAGCACCACCAGGACCUGACCCUGCUGAAAGCUCUCGUGCGGC
AGCAGCUGCCUGAGAAGUACAAAGAGAUUUUCUUCGACCAGAGCAAGAACGGCUACG
CCGGCUACAUUGACGGCGGAGCCAGCCAGGAAGAGUUCUACAAGUUCAUCAAGCCCAU
CCUGGAAAAGAUGGACGGCACCGAGGAACUGCUCGUGAAGCUGAACAGAGAGGACCU
GCUGCGGAAGCAGCGGACCUUCGACAACGGCAGCAUCCCCCACCAGAUCCACCUGGGA
GAGCUGCACGCCAUUCUGCGGCGGCAGGAAGAUUUUUACCCAUUCCUGAAGGACAACC
GGGAAAAGAUCGAGAAGAUCCUGACCUUCCGCAUCCCCUACUACGUGGGCCCUCUGGC
CAGGGGAAACAGCAGAUUCGCCUGGAUGACCAGAAAGAGCGAGGAAACCAUCACCCCC
UGGAACUUCGAGGAAGUGGUGGACAAGGGCGCUUCCGCCCAGAGCUUCAUCGAGCGG
AUGACCAACUUCGAUAAGAACCUGCCCAACGAGAAGGUGCUGCCCAAGCACAGCCUGC
UGUACGAGUACUUCACCGUGUAUAACGAGCUGACCAAAGUGAAAUACGUGACCGAGG
GAAUGAGAAAGCCCGCCUUCCUGAGCGGCGAGCAGAAAAAGGCCAUCGUGGACCUGCU
GUUCAAGACCAACCGGAAAGUGACCGUGAAGCAGCUGAAAGAGGACUACUUCAAGAA
AAUCGAGUGCUUCGACUCCGUGGAAAUCUCCGGCGUGGAAGAUCGGUUCAACGCCUCC
CUGGGCACAUACCACGAUCUGCUGAAAAUUAUCAAGGACAAGGACUUCCUGGACAAU
GAGGAAAACGAGGACAUUCUGGAAGAUAUCGUGCUGACCCUGACACUGUUUGAGGAC
AGAGAGAUGAUCGAGGAACGGCUGAAAACCUAUGCCCACCUGUUCGACGACAAAGUG
AUGAAGCAGCUGAAGCGGCGGAGAUACACCGGCUGGGGCAGGCUGAGCCGGAAGCUG
AUCAACGGCAUCCGGGACAAGCAGUCCGGCAAGACAAUCCUGGAUUUCCUGAAGUCCG
ACGGCUUCGCCAACAGAAACUUCAUGCAGCUGAUCCACGACGACAGCCUGACCUUUAA
AGAGGACAUCCAGAAAGCCCAGGUGUCCGGCCAGGGCGAUAGCCUGCACGAGCACAUU
GCCAAUCUGGCCGGCAGCCCCGCCAUUAAGAAGGGCAUCCUGCAGACAGUGAAGGUGG
UGGACGAGCUCGUGAAAGUGAUGGGCCGGCACAAGCCCGAGAACAUCGUGAUCGAAA
UGGCCAGAGAGAACCAGACCACCCAGAAGGGACAGAAGAACAGCCGCGAGAGAAUGA
AGCGGAUCGAAGAGGGCAUCAAAGAGCUGGGCAGCCAGAUCCUGAAAGAACACCCCG
UGGAAAAACACCCAGCUGCAGAACGAGAAGCUGUACCUGUACUACCUGCAGAAUGGGC
GGGAUAUGUACGUGGACCAGGAACUGGACAUCAACCGGCUGUCCGACUACGAUGUGG
ACCAUAUCGUGCCUCAGAGCUUUCUGAAGGACGACUCCAUCGACAACAAGGUGCUGAC
CAGAAGCGACAAGAACCGGGGCAAGAGCGACAACGUGCCCUCCGAAGAGGUCGUGAA
GAAGAUGAAGAACUACUGGCGGCAGCUGCUGAACGCCAAGCUGAUUACCCAGAGAAA
GUUCGACAAUCUGACCAAGGCCGAGAGAGGCGGCCUGAGCGAACUGGAUAAGGCCGG
CUUCAUCAAGAGACAGCUGGUGGAAACCCGGCAGAUCACAAAGCACGUGGCACAGAUC
CUGGACUCCCGGAUGAACACUAAGUACGACGAGAAUGACAAGCUGAUCCGGGAAGUG
```

-continued

AAAGUGAUCACCCUGAAGUCCAAGCUGGUGUCCGAUUUCCGGAAGGAUUUCCAGUUU
UACAAAGUGCGCGAGAUCAACAACUACCACCACGCCCACGACGCCUACCUGAACGCCG
UCGUGGGAACCGCCCUGAUCAAAAAGUACCCUAAGCUGGAAAGCGAGUUCGUGUACG
GCGACUACAAGGUGUACGACGUGCGGAAGAUGAUCGCCAAGAGCGAGCAGGAAAUCG
GCAAGGCUACCGCCAAGUACUUCUUCUACAGCAACAUCAUGAACUUUUUCAAGACCGA
GAUUACCCUGGCCAACGGCGAGAUCCGGAAGCGGCCUCUGAUCGAGACAAACGGCGAA
ACCGGGGAGAUCGUGUGGGAUAAGGGCCGGGAUUUUGCCACCGUGCGGAAAGUGCUG
AGCAUGCCCCAAGUGAAUAUCGUGAAAAAGACCGAGGUGCAGACAGGCGGCUUCAGC
AAAGAGUCUAUCCUGCCCAAGAGGAACAGCGAUAAGCUGAUCGCCAGAAAGAAGGAC
UGGGACCCUAAGAAGUACGGCGGCUUCGACAGCCCCACCGUGGCCUAUUCUGUGCUGG
UGGUGGCCAAAGUGGAAAAGGGCAAGUCCAAGAAACUGAAGAGUGUGAAAGAGCUGC
UGGGGAUCACCAUCAUGGAAAGAAGCAGCUUCGAGAAGAAUCCCAUCGACUUUCUGG
AAGCCAAGGGCUACAAAGAAGUGAAAAAGGACCUGAUCAUCAAGCUGCCUAAGUACU
CCCUGUUCGAGCUGGAAAACGGCCGGAAGAGAAUGCUGGCCUCUGCCGGCGAACUGCA
GAAGGGAAACGAACUGGCCCUGCCCUCCAAAUAUGUGAACUUCCUGUACCUGGCCAGC
CACUAUGAGAAGCUGAAGGGCUCCCCCGAGGAUAAUGAGCAGAAACAGCUGUUUGUG
GAACAGCACAAGCACUACCUGGACGAGAUCAUCGAGCAGAUCAGCGAGUUCUCCAAGA
GAGUGAUCCUGGCCGACGCUAAUCUGGACAAAGUGCUGUCCGCCUACAACAAGCACCG
GGAUAAGCCCAUCAGAGAGCAGGCCGAGAAUAUCAUCCACCUGUUUACCCUGACCAAU
CUGGGAGCCCCUGCCGCCUUCAAGUACUUUGACACCACCAUCGACCGGAAGAGGUACA
CCAGCACCAAAGAGGUGCUGGACGCCACCCUGAUCCACCAGAGCAUCACCGGCCUGUA
CGAGACACGGAUCGACCUGUCUCAGCUGGGAGGCGAC (*AAAAGGCCGGCGGCCACGAAAA*
*AGGCCGGCCAGGCAAAAAAGAAAAAGUGAGGUACCGUCGCACACAUCCUAUUUGGGCCUA*
*GCAACCAACAGUAUG*) GGUCUGGGCGCACUUCGGUGACGGUACAGGCC (*GUCACGGUUC*
*U*UCGACAAUCAACCUCUGGAUUACAAAAUUUGUGAAAGAUUGACUGGUAUUCUUAA
CUAUGUUGCUCCUUUUACGCUAUGUGGAUACGCUGCUUUAAUGCCUUUGUAUCAU
GCUAUUGCUUCCCGUAUGGCUUUCAUUUUCUCCUCCUUGUAUAAAUCCUGGUUGCU
GUCUCUUUAUGAGGAGUUGUGGCCCGUUGUCAGGCAACGUGGCGUGGUGUGCACU
GUGUUUGCUGACGCAACCCCCACUGGUUGGGCAUUGCCACCACCUGUCAGCUCC
UUUCCGGGACUUUCGCUUUCCCCCUCCCUAUUGCCACGGCGGAACUCAUCGCCGC
CUGCCUUGCCCGCUGCUGGACAGGGGCUCGGCUGUUUGGGCACUGACAAUUCCGUG
GUGUUGUCGGGGAAGCUGACGUCCUUUCCAUGGCUGCUCGCCUGUGUUGCCACCU
GGAUUCUGCGCGGGACGUCCUUCUGCUACGUCCCUUCGGCCCUCAAUCCAGCGGA
CCUUCCUUCCCGCGGCCUGCUGCCGGCUCUGCGGCCUCUUCCGCGUCUUCGCCUU
CGCCCUCAGACGAGUCGGAUCUCCCUUUGGGCCGCCUCCCCGCCUGGAAUUCG)

SEQ ID NO: 375

FLAG-Cas9-mnb

GGCUCGUGUAGCUCAUUAGCUCCGAGCC (*UAGGAUUACUGCUCGGUGACUUAUAAUCAU*
*CCUCCCCGCCACC*AUGGACUAUAAGGACCACGACGGAGACUACAAGGAUCAUGAUA
UUGAUUACAAAGACGAUGACGAUAAGAUGGCCCCAAAGAAGAAGCGGAAGGUC) GGUA
UCCACGGAGUCCCAGCAGCCGACAAGAAGUACAGCAUCGGCCUGGACAUCGGCACCAA
CUCUGUGGGCUGGGCCGUGAUCACCGACGAGUACAAGGUGCCCAGCAAGAAAUUCAA

```
GGUGCUGGGCAACACCGACCGGCACAGCAUCAAGAAGAACCUGAUCGGAGCCCUGCUG

UUCGACAGCGGCGAAACAGCCGAGGCCACCCGGCUGAAGAGAACCGCCAGAAGAAGAU

ACACCAGACGGAAGAACCGGAUCUGCUAUCUGCAAGAGAUCUUCAGCAACGAGAUGG

CCAAGGUGGACGACAGCUUCUUCCACAGACUGGAAGAGUCCUUCCUGGUGGAAGAGG

AUAAGAAGCACGAGCGGCACCCCAUCUUCGGCAACAUCGUGGACGAGGUGGCCUACCA

CGAGAAGUACCCCACCAUCUACCACCUGAGAAAGAAACUGGUGGACAGCACCGACAAG

GCCGACCUGCGGCUGAUCUAUCUGGCCCUGGCCCACAUGAUCAAGUUCCGGGGCCACU

UCCUGAUCGAGGGCGACCUGAACCCCGACAACAGCGACGUGGACAAGCUGUUCAUCCA

GCUGGUGCAGACCUACAACCAGCUGUUCGAGGAAAACCCCAUCAACGCCAGCGGCGUG

GACGCCAAGGCCAUCCUGUCUGCCAGACUGAGCAAGAGCAGACGGCUGGAAAAUCUGA

UCGCCCAGCUGCCCGGCGAGAAGAAGAAUGGCCUGUUCGGAAACCUGAUUGCCCUGAG

CCUGGGCCUGACCCCCAACUUCAAGAGCAACUUCGACCUGGCCGAGGAUGCCAAACUG

CAGCUGAGCAAGGACACCUACGACGACGACCUGGACAACCUGCUGGCCCAGAUCGGCG

ACCAGUACGCCGACCUGUUUCUGGCCGCCAAGAACCUGUCCGACGCCAUCCUGCUGAG

CGACAUCCUGAGAGUGAACACCGAGAUCACCAAGGCCCCCCUGAGCGCCUCUAUGAUC

AAGAGAUACGACGAGCACCACCAGGACCUGACCCUGCUGAAAGCUCUCGUGCGGCAGC

AGCUGCCUGAGAAGUACAAAGAGAUUUUCUUCGACCAGAGCAAGAACGGCUACGCCG

GCUACAUUGACGGCGGAGCCAGCCAGGAAGAGUUCUACAAGUUCAUCAAGCCCAUCCU

GGAAAAGAUGGACGGCACCGAGGAACUGCUCGUGAAGCUGAACAGAGAGGACCUGCU

GCGGAAGCAGCGGACCUUCGACAACGGCAGCAUCCCCCACCAGAUCCACCUGGGAGAG

CUGCACGCCAUUCUGCGGCGGCAGGAAGAUUUUUACCCAUUCCUGAAGGACAACCGGG

AAAAGAUCGAGAAGAUCCUGACCUUCCGCAUCCCCUACUACGUGGGCCCUCUGGCCAG

GGGAAACAGCAGAUUCGCCUGGAUGACCAGAAAGAGCGAGGAAACCAUCACCCCCUGG

AACUUCGAGGAAGUGGUGGACAAGGGCGCUUCCGCCCAGAGCUUCAUCGAGCGGAUG

ACCAACUUCGAUAAGAACCUGCCCAACGAGAAGGUGCUGCCCAAGCACAGCCUGCUGU

ACGAGUACUUCACCGUGUAUAACGAGCUGACCAAAGUGAAAUACGUGACCGAGGGAA

UGAGAAAGCCCGCCUUCCUGAGCGGCGAGCAGAAAAAGGCCAUCGUGGACCUGCUGUU

CAAGACCAACCGGAAAGUGACCGUGAAGCAGCUGAAAGAGGACUACUUCAAGAAAAU

CGAGUGCUUCGACUCCGUGGAAAUCUCCGGCGUGGAAGAUCGGUUCAACGCCUCCCUG

GGCACAUACCACGAUCUGCUGAAAAUUAUCAAGGACAAGGACUUCCUGGACAAUGAG

GAAAACGAGGACAUUCUGGAAGAUAUCGUGCUGACCCUGACACUGUUUGAGGACAGA

GAGAUGAUCGAGGAACGGCUGAAAACCUAUGCCCACCUGUUCGACGACAAAGUGAUG

AAGCAGCUGAAGCGGCGGAGAUACACCGGCUGGGGCAGGCUGAGCCGGAAGCUGAUC

AACGGCAUCCGGGACAAGCAGUCCGGCAAGACAAUCCUGGAUUUCCUGAAGUCCGACG

GCUUCGCCAACAGAAACUUCAUGCAGCUGAUCCACGACGACAGCCUGACCUUUAAAGA

GGACAUCCAGAAAGCCCAGGUGUCCGGCCAGGGCGAUAGCCUGCACGAGCACAUUGCC

AAUCUGGCCGGCAGCCCCGCCAUUAAGAAGGGCAUCCUGCAGACAGUGAAGGUGGUG

GACGAGCUCGUGAAAGUGAUGGGCCGGCACAAGCCCGAGAACAUCGUGAUCGAAAUG

GCCAGAGAGAACCAGACCACCCAGAAGGGACAGAAGAACAGCCGCGAGAGAAUGAAG

CGGAUCGAAGAGGGCAUCAAAGAGCUGGGCAGCCAGAUCCUGAAAGAACACCCCGUG
```

-continued

```
GAAAACACCCAGCUGCAGAACGAGAAGCUGUACCUGUACUACCUGCAGAAUGGGCGG

GAUAUGUACGUGGACCAGGAACUGGACAUCAACCGGCUGUCCGACUACGAUGUGGAC

CAUAUCGUGCCUCAGAGCUUUCUGAAGGACGACUCCAUCGACAACAAGGUGCUGACCA

GAAGCGACAAGAACCGGGGCAAGAGCGACAACGUGCCCUCCGAAGAGGUCGUGAAGA

AGAUGAAGAACUACUGGCGGCAGCUGCUGAACGCCAAGCUGAUUACCCAGAGAAAGU

UCGACAAUCUGACCAAGGCCGAGAGAGGCGGCCUGAGCGAACUGGAUAAGGCCGGCU

UCAUCAAGAGACAGCUGGUGGAAACCCGGCAGAUCACAAAGCACGUGGCACAGAUCCU

GGACUCCCCGGAUGAACACUAAGUACGACGAGAAUGACAAGCUGAUCCGGGAAGUGAA

AGUGAUCACCCUGAAGUCCAAGCUGGUGUCCGAUUUCCGGAAGGAUUUCCAGUUUUA

CAAAGUGCGCGAGAUCAACAACUACCACCACGCCCACGACGCCUACCUGAACGCCGUC

GUGGGAACCGCCCUGAUCAAAAAGUACCCUAAGCUGGAAAGCGAGUUCGUGUACGGC

GACUACAAGGUGUACGACGUGCGGAAGAUGAUCGCCAAGAGCGAGCAGGAAAUCGGC

AAGGCUACCGCCAAGUACUUCUUCUACAGCAACAUCAUGAACUUUUUCAAGACCGAGA

UUACCCUGGCCAACGGCGAGAUCCGGAAGCGGCCUCUGAUCGAGACAAACGGCGAAAC

CGGGGAGAUCGUGUGGGAUAAGGGCCGGGAUUUUGCCACCGUGCGGAAAGUGCUGAG

CAUGCCCCAAGUGAAUAUCGUGAAAAAGACCGAGGUGCAGACAGGCGGCUUCAGCAA

AGAGUCUAUCCUGCCCAAGAGGAACAGCGAUAAGCUGAUCGCCAGAAAGAAGGACUG

GGACCCUAAGAAGUACGGCGGCUUCGACAGCCCCACCGUGGCCUAUUCUGUGCUGGUG

GUGGCCAAAGUGGAAAAGGGCAAGUCCAAGAAACUGAAGAGUGUGAAAGAGCUGCUG

GGGAUCACCAUCAUGGAAAGAAGCAGCUUCGAGAAGAAUCCCAUCGACUUUCUGGAA

GCCAAGGGCUACAAAGAAGUGAAAAAGGACCUGAUCAUCAAGCUGCCUAAGUACUCC

CUGUUCGAGCUGGAAAACGGCCGGAAGAGAAUGCUGGCCUCUGCCGGCGAACUGCAG

AAGGGAAACGAACUGGCCCUGCCCUCCAAAUAUGUGAACUUCCUGUACCUGGCCAGCC

ACUAUGAGAAGCUGAAGGGCUCCCCCGAGGAUAAUGAGCAGAAACAGCUGUUUGUGG

AACAGCACAAGCACUACCUGGACGAGAUCAUCGAGCAGAUCAGCGAGUUCUCCAAGAG

AGUGAUCCUGGCCGACGCUAAUCUGGACAAAGUGCUGUCCGCCUACAACAAGCACCGG

GAUAAGCCCAUCAGAGAGCAGGCCGAGAAUAUCAUCCACCUGUUUACCCUGACCAAUC

UGGGAGCCCCUGCCGCCUUCAAGUACUUUGACACCACCAUCGACCGGAAGAGGUACAC

CAGCACCAAAGAGGUGCUGGACGCCACCCUGAUCCACCAGAGCAUCACCGGCCUGUAC

GAGACACGGAUCGACCUGUCUCAGCUGGGAGGCGAC (*AAAAGGCCGGCGGCCACGAAAAA*

*GGCCGGCCAGGCAAAAAAGAAAAAGUGA**GUCGCACACAUCCUAUUUGGGCCUAGCAACCA*

*ACAGUAUG*) GGCUCGUGUAGCUCAUUAGCUCCGAGCC
```

SEQ ID NO: 376

FLAG-Cas9-noHP_WPRE (UAGGAUUACUGCUCGGUGACUUAUAAUCAUCCUCCCCGCCACCAUGGACUAUAAGGA
CCACGACGGAGACUACAAGGAUCAUGAUAUUGAUUACAAAGACGAUGACGAUAAG
*AUGGCCCCAAAGAAGAAGCGGAAGGUC*) GGUAUCCACGGAGUCCCAGCAGCCGACAAGAA

GUACAGCAUCGGCCUGGACAUCGGCACCAACUCUGUGGGCUGGGCCGUGAUCACCGAC

GAGUACAAGGUGCCCAGCAAGAAAUUCAAGGUGCUGGGCAACACCGACCGGCACAGCA

UCAAGAAGAACCUGAUCGGAGCCCUGCUGUUCGACAGCGGCGAAACAGCCGAGGCCAC

CCGGCUGAAGAGAACCGCCAGAAGAAGAUACACCAGACGGAAGAACCGGAUCUGCUA

UCUGCAAGAGAUCUUCAGCAACGAGAUGGCCAAGGUGGACGACAGCUUCUUCCACAG

-continued

```
ACUGGAAGAGUCCUUCCUGGUGGAAGAGGAUAAGAAGCACGAGCGGCACCCCAUCUU
CGGCAACAUCGUGGACGAGGUGGCCUACCACGAGAAGUACCCCACCAUCUACCACCUG
AGAAAGAAACUGGUGGACAGCACCGACAAGGCCGACCUGCGGCUGAUCUAUCUGGCCC
UGGCCCACAUGAUCAAGUUCCGGGGCCACUUCCUGAUCGAGGGCGACCUGAACCCCGA
CAACAGCGACGUGGACAAGCUGUUCAUCCAGCUGGUGCAGACCUACAACCAGCUGUUC
GAGGAAAACCCCAUCAACGCCAGCGGCGUGGACGCCAAGGCCAUCCUGUCUGCCAGAC
UGAGCAAGAGCAGACGGCUGGAAAAUCUGAUCGCCCAGCUGCCCGGCGAGAAGAAGA
AUGGCCUGUUCGGAAACCUGAUUGCCCUGAGCCUGGGCCUGACCCCCAACUUCAAGAG
CAACUUCGACCUGGCCGAGGAUGCCAAACUGCAGCUGAGCAAGGACACCUACGACGAC
GACCUGGACAACCUGCUGGCCCAGAUCGGCGACCAGUACGCCGACCUGUUUCUGGCCG
CCAAGAACCUGUCCGACGCCAUCCUGCUGAGCGACAUCCUGAGAGUGAACACCGAGAU
CACCAAGGCCCCCCUGAGCGCCUCUAUGAUCAAGAGAUACGACGAGCACCACCAGGAC
CUGACCCUGCUGAAAGCUCUCGUGCGGCAGCAGCUGCCUGAGAAGUACAAAGAGAUU
UUCUUCGACCAGAGCAAGAACGGCUACGCCGGCUACAUUGACGGCGGAGCCAGCCAGG
AAGAGUUCUACAAGUUCAUCAAGCCCAUCCUGGAAAAGAUGGACGGCACCGAGGAAC
UGCUCGUGAAGCUGAACAGAGAGGACCUGCUGCGGAAGCAGCGGACCUUCGACAACG
GCAGCAUCCCCCACCAGAUCCACCUGGGAGAGCUGCACGCCAUUCUGCGGCGGCAGGA
AGAUUUUUACCCAUUCCUGAAGGACAACCGGGAAAAGAUCGAGAAGAUCCUGACCUU
CCGCAUCCCCUACUACGUGGGCCCUCUGGCCAGGGGAAACAGCAGAUUCGCCUGGAUG
ACCAGAAAGAGCGAGGAAACCAUCACCCCCUGGAACUUCGAGGAAGUGGUGGACAAG
GGCGCUUCCGCCCAGAGCUUCAUCGAGCGGAUGACCAACUUCGAUAAGAACCUGCCCA
ACGAGAAGGUGCUGCCCAAGCACAGCCUGCUGUACGAGUACUUCACCGUGUAUAACGA
GCUGACCAAAGUGAAAUACGUGACCGAGGGAAUGAGAAAGCCCGCCUUCCUGAGCGG
CGAGCAGAAAAAGGCCAUCGUGGACCUGCUGUUCAAGACCAACCGGAAAGUGACCGU
GAAGCAGCUGAAAGAGGACUACUUCAAGAAAAUCGAGUGCUUCGACUCCGUGGAAAU
CUCCGGCGUGGAAGAUCGGUUCAACGCCUCCCUGGGCACAUACCACGAUCUGCUGAAA
AUUAUCAAGGACAAGGACUUCCUGGACAAUGAGGAAAACGAGGACAUUCUGGAAGAU
AUCGUGCUGACCCUGACACUGUUUGAGGACAGAGAGAUGAUCGAGGAACGGCUGAAA
ACCUAUGCCCACCUGUUCGACGACAAAGUGAUGAAGCAGCUGAAGCGGCGGAGAUAC
ACCGGCUGGGGCAGGCUGAGCCGGAAGCUGAUCAACGGCAUCCGGGACAAGCAGUCCG
GCAAGACAAUCCUGGAUUUCCUGAAGUCCGACGGCUUCGCCAACAGAAACUUCAUGCA
GCUGAUCCACGACGACAGCCUGACCUUUAAAGAGGACAUCCAGAAAGCCCAGGUGUCC
GGCCAGGGCGAUAGCCUGCACGAGCACAUUGCCAAUCUGGCCGGCAGCCCCGCCAUUA
AGAAGGGCAUCCUGCAGACAGUGAAGGUGGUGGACGAGCUCGUGAAAGUGAUGGGCC
GGCACAAGCCCGAGAACAUCGUGAUCGAAAUGGCCAGAGAGAACCAGACCACCCAGAA
GGGACAGAAGAACAGCCGCGAGAGAAUGAAGCGGAUCGAAGAGGGCAUCAAAGAGCU
GGGCAGCCAGAUCCUGAAAGAACACCCCGUGGAAAACACCCAGCUGCAGAACGAGAAG
CUGUACCUGUACUACCUGCAGAAUGGGCGGGAUAUGUACGUGGACCAGGAACUGGAC
AUCAACCGGCUGUCCGACUACGAUGUGGACCAUAUCGUGCCUCAGAGCUUUCUGAAGG
ACGACUCCAUCGACAACAAGGUGCUGACCAGAAGCGACAAGAACCGGGGCAAGAGCGA
```

-continued

```
CAACGUGCCCUCCGAAGAGGUCGUGAAGAAGAUGAAGAACUACUGGCGGCAGCUGCU

GAACGCCAAGCUGAUUACCCAGAGAAAGUUCGACAAUCUGACCAAGGCCGAGAGAGG

CGGCCUGAGCGAACUGGAUAAGGCCGGCUUCAUCAAGAGACAGCUGGUGGAAACCCG

GCAGAUCACAAAGCACGUGGCACAGAUCCUGGACUCCCGGAUGAACACUAAGUACGAC

GAGAAUGACAAGCUGAUCCGGGAAGUGAAAGUGAUCACCCUGAAGUCCAAGCUGGUG

UCCGAUUUCCGGAAGGAUUUCCAGUUUUACAAAGUGCGCGAGAUCAACAACUACCACC

ACGCCCACGACGCCUACCUGAACGCCGUCGUGGGAACCGCCCUGAUCAAAAAGUACCC

UAAGCUGGAAAGCGAGUUCGUGUACGGCGACUACAAGGUGUACGACGUGCGGAAGAU

GAUCGCCAAGAGCGAGCAGGAAAUCGGCAAGGCUACCGCCAAGUACUUCUUCUACAGC

AACAUCAUGAACUUUUUCAAGACCGAGAUUACCCUGGCCAACGGCGAGAUCCGGAAGC

GGCCUCUGAUCGAGACAAACGGCGAAACCGGGGAGAUCGUGUGGGAUAAGGGCCGGG

AUUUUGCCACCGUGCGGAAAGUGCUGAGCAUGCCCCAAGUGAAUAUCGUGAAAAAGA

CCGAGGUGCAGACAGGCGGCUUCAGCAAAGAGUCUAUCCUGCCCAAGAGGAACAGCGA

UAAGCUGAUCGCCAGAAAGAAGGACUGGGACCCUAAGAAGUACGGCGGCUUCGACAG

CCCCACCGUGGCCUAUUCUGUGCUGGUGGUGGCCAAAGUGGAAAAGGGCAAGUCCAA

GAAACUGAAGAGUGUGAAAGAGCUGCUGGGGAUCACCAUCAUGGAAAGAAGCAGCUU

CGAGAAGAAUCCCAUCGACUUUCUGGAAGCCAAGGGCUACAAAGAAGUGAAAAAGGA

CCUGAUCAUCAAGCUGCCUAAGUACUCCCUGUUCGAGCUGGAAAACGGCCGGAAGAGA

AUGCUGGCCUCUGCCGGCGAACUGCAGAAGGGAAACGAACUGGCCCUGCCCUCCAAAU

AUGUGAACUUCCUGUACCUGGCCAGCCACUAUGAGAAGCUGAAGGGCUCCCCCGAGGA

UAAUGAGCAGAAACAGCUGUUUGUGGAACAGCACAAGCACUACCUGGACGAGAUCAU

CGAGCAGAUCAGCGAGUUCUCCAAGAGAGUGAUCCUGGCCGACGCUAAUCUGGACAA

AGUGCUGUCCGCCUACAACAAGCACCGGGAUAAGCCCAUCAGAGAGCAGGCCGAGAAU

AUCAUCCACCUGUUUACCCUGACCAAUCUGGGGAGCCCCUGCCGCCUUCAAGUACUUUG

ACACCACCAUCGACCGGAAGAGGUACACCAGCACCAAAGAGGUGCUGGACGCCACCCU

GAUCCACCAGAGCAUCACCGGCCUGUACGAGACACGGAUCGACCUGUCUCAGCUGGGA

GGCGAC (AAAAGGCCGGCGGCCACGAAAAAGGCCGGCCAGGCAAAAAAGAAAAAGUGA𝑮𝑮𝑼

𝑨𝑪𝑪𝑮𝑼𝑪𝑮𝑪𝑨𝑪𝑨𝑪𝑨𝑼𝑪𝑪𝑼𝑨𝑼𝑼𝑼𝑮𝑮𝑮𝑪𝑪𝑼𝑨𝑮𝑪𝑨𝑨𝑪𝑪𝑨𝑨𝑪𝑨𝑮𝑼𝑨𝑼𝑮GUCACGGUUCUUCGAC

AAUCAACCUCUGGAUUACAAAAUUUGUGAAAGAUUGACUGGUAUUCUUAACUAUGU

UGCUCCUUUUACGCUAUGUGGAUACGCUGCUUUAAUGCCUUUGUAUCAUGCUAUU

GCUUCCCGUAUGGCUUUCAUUUUCUCCUCCUUGUAUAAAUCCUGGUUGCUGUCUCU

UUAUGAGGAGUUGUGGCCCGUUGUCAGGCAACGUGGCGUGGUGUGCACUGUGUUU

GCUGACGCAACCCCCACUGGUUGGGGCAUUGCCACCACCUGUCAGCUCCUUUCCG

GGACUUUCGCUUUCCCCCUCCCUAUUGCCACGGCGGAACUCAUCGCCGCCUGCCU

UGCCCGCUGCUGGACAGGGGCUCGGCUGUUGGGCACUGACAAUUCCGUGGUGUUG

UCGGGGAAGCUGACGUCCUUUCCAUGGCUGCUCGCCUGUGUUGCCACCUGGAUUC

UGCGCGGGACGUCCUUCUGCUACGUCCCUUCGGCCCUCAAUCCAGCGGACCUUCC

UUCCCGCGGCCUGCUGCCGGCUCUGCGGCCUCUUCCGCGUCUUCGCCUUCGCCCU

CAGACGAGUCGGAUCUCCCUUUGGGCCGCCUCCCCGCCUGGAAUUCG)
```

-continued

SEQ ID NO: 377

FLAG-Cas9-u1a_WPRE
AAUCCAUUGCACUCCGGAUUU (*UAGGAUUACUGCUCGGUGACUUAUAAUCAUCCUCCCC*

*GCCACC*AUGGACUAUAAGGACCACGACGGAGACUACAAGGAUCAUGAUAUUGAUUA

CAAAGACGAUGACGAUAAG*AUGGCCCCAAAGAAGAAGCGGAAGGUC*) GGUAUCCACGGA

GUCCCAGCAGCCGACAAGAAGUACAGCAUCGGCCUGGACAUCGGCACCAACUCUGUGG

GCUGGGCCGUGAUCACCGACGAGUACAAGGUGCCCAGCAAGAAAUUCAAGGUGCUGG

GCAACACCGACCGGCACAGCAUCAAGAAGAACCUGAUCGGAGCCCUGCUGUUCGACAG

CGGCGAAACAGCCGAGGCCACCCGGCUGAAGAGAACCGCCAGAAGAAGAUACACCAGA

CGGAAGAACCGGAUCUGCUAUCUGCAAGAGAUCUUCAGCAACGAGAUGGCCAAGGUG

GACGACAGCUUCUUCCACAGACUGGAAGAGUCCUUCCUGGUGGAAGAGGAUAAGAAG

CACGAGCGGCACCCCAUCUUCGGCAACAUCGUGGACGAGGUGGCCUACCACGAGAAGU

ACCCCACCAUCUACCACCUGAGAAAGAAACUGGUGGACAGCACCGACAAGGCCGACCU

GCGGCUGAUCUAUCUGGCCCUGGCCCACAUGAUCAAGUUCCGGGGCCACUUCCUGAUC

GAGGGCGACCUGAACCCCGACAACAGCGACGUGGACAAGCUGUUCAUCCAGCUGGUGC

AGACCUACAACCAGCUGUUCGAGGAAAACCCCAUCAACGCCAGCGGCGUGGACGCCAA

GGCCAUCCUGUCUGCCAGACUGAGCAAGAGCAGACGGCUGGAAAAUCUGAUCGCCCAG

CUGCCCGGCGAGAAGAAGAAUGGCCUGUUCGGAAACCUGAUUGCCCUGAGCCUGGGCC

UGACCCCCAACUUCAAGAGCAACUUCGACCUGGCCGAGGAUGCCAAACUGCAGCUGAG

CAAGGACACCUACGACGACGACCUGGACAACCUGCUGGCCCAGAUCGGCGACCAGUAC

GCCGACCUGUUUCUGGCCGCCAAGAACCUGUCCGACGCCAUCCUGCUGAGCGACAUCC

UGAGAGUGAACACCGAGAUCACCAAGGCCCCCCUGAGCGCCUCUAUGAUCAAGAGAUA

CGACGAGCACCACCAGGACCUGACCCUGCUGAAAGCUCUCGUGCGGCAGCAGCUGCCU

GAGAAGUACAAAGAGAUUUUCUUCGACCAGAGCAAGAACGGCUACGCCGGCUACAUU

GACGGCGGAGCCAGCCAGGAAGAGUUCUACAAGUUCAUCAAGCCCAUCCUGGAAAAG

AUGGACGGCACCGAGGAACUGCUCGUGAAGCUGAACAGAGAGGACCUGCUGCGGAAG

CAGCGGACCUUCGACAACGGCAGCAUCCCCCACCAGAUCCACCUGGGAGAGCUGCACG

CCAUUCUGCGGCGGCAGGAAGAUUUUUACCCAUUCCUGAAGGACAACCGGGAAAAGA

UCGAGAAGAUCCUGACCUUCCGCAUCCCCUACUACGUGGGCCCUCUGGCCAGGGGAAA

CAGCAGAUUCGCCUGGAUGACCAGAAAGAGCGAGGAAACCAUCACCCCCUGGAACUUC

GAGGAAGUGGUGGACAAGGGCGCUUCCGCCCAGAGCUUCAUCGAGCGGAUGACCAAC

UUCGAUAAGAACCUGCCCAACGAGAAGGUGCUGCCCAAGCACAGCCUGCUGUACGAGU

ACUUCACCGUGUAUAACGAGCUGACCAAAGUGAAAUACGUGACCGAGGGAAUGAGAA

AGCCCGCCUUCCUGAGCGGCGAGCAGAAAAAGGCCAUCGUGGACCUGCUGUUCAAGAC

CAACCGGAAAGUGACCGUGAAGCAGCUGAAAGAGGACUACUUCAAGAAAAUCGAGUG

CUUCGACUCCGUGGAAAUCUCCGGCGUGGAAGAUCGGUUCAACGCCUCCCUGGGCACA

UACCACGAUCUGCUGAAAAUUAUCAAGGACAAGGACUUCCUGGACAAUGAGGAAAAC

GAGGACAUUCUGGAAGAUAUCGUGCUGACCCUGACACUGUUUGAGGACAGAGAGAUG

AUCGAGGAACGGCUGAAAACCUAUGCCCACCUGUUCGACGACAAAGUGAUGAAGCAG

CUGAAGCGGCGGAGAUACACCGGCUGGGGCAGGCUGAGCCGGAAGCUGAUCAACGGC

AUCCGGGACAAGCAGUCCGGCAAGACAAUCCUGGAUUUCCUGAAGUCCGACGGCUUCG

-continued

CCAACAGAAACUUCAUGCAGCUGAUCCACGACGACAGCCUGACCUUUAAAGAGGACAU

CCAGAAAGCCCAGGUGUCCGGCCAGGGCGAUAGCCUGCACGAGCACAUUGCCAAUCUG

GCCGGCAGCCCCGCCAUUAAGAAGGGCAUCCUGCAGACAGUGAAGGUGGUGGACGAGC

UCGUGAAAGUGAUGGGCCGGCACAAGCCCGAGAACAUCGUGAUCGAAAUGGCCAGAG

AGAACCAGACCACCCAGAAGGGACAGAAGAACAGCCGCGAGAGAAUGAAGCGGAUCG

AAGAGGGCAUCAAAGAGCUGGGCAGCCAGAUCCUGAAAGAACACCCCGUGGAAAACA

CCCAGCUGCAGAACGAGAAGCUGUACCUGUACUACCUGCAGAAUGGGCGGGAUAUGU

ACGUGGACCAGGAACUGGACAUCAACCGGCUGUCCGACUACGAUGUGGACCAUAUCGU

GCCUCAGAGCUUUCUGAAGGACGACUCCAUCGACAACAAGGUGCUGACCAGAAGCGAC

AAGAACCGGGGCAAGAGCGACAACGUGCCCUCCGAAGAGGUCGUGAAGAAGAUGAAG

AACUACUGGCGGCAGCUGCUGAACGCCAAGCUGAUUACCCAGAGAAAGUUCGACAAUC

UGACCAAGGCCGAGAGAGGCGGCCUGAGCGAACUGGAUAAGGCCGGCUUCAUCAAGA

GACAGCUGGUGGAAACCCGGCAGAUCACAAAGCACGUGGCACAGAUCCUGGACUCCCG

GAUGAACACUAAGUACGACGAGAAUGACAAGCUGAUCCGGGAAGUGAAAGUGAUCAC

CCUGAAGUCCAAGCUGGUGUCCGAUUUCCGGAAGGAUUUCCAGUUUUACAAAGUGCG

CGAGAUCAACAACUACCACCACGCCCACGACGCCUACCUGAACGCCGUCGUGGGAACC

GCCCUGAUCAAAAAGUACCCUAAGCUGGAAAGCGAGUUCGUGUACGGCGACUACAAG

GUGUACGACGUGCGGAAGAUGAUCGCCAAGAGCGAGCAGGAAAUCGGCAAGGCUACC

GCCAAGUACUUCUUCUACAGCAACAUCAUGAACUUUUUCAAGACCGAGAUUACCCUGG

CCAACGGCGAGAUCCGGAAGCGGCCUCUGAUCGAGACAAACGGCGAAACCGGGGAGAU

CGUGUGGGAUAAGGGCCGGGAUUUUGCCACCGUGCGGAAAGUGCUGAGCAUGCCCCA

AGUGAAUAUCGUGAAAAAGACCGAGGUGCAGACAGGCGGCUUCAGCAAAGAGUCUAU

CCUGCCCAAGAGGAACAGCGAUAAGCUGAUCGCCAGAAAGAAGGACUGGGACCCUAA

GAAGUACGGCGGCUUCGACAGCCCCACCGUGGCCUAUUCUGUGCUGGUGGUGGCCAAA

GUGGAAAAGGGCAAGUCCAAGAAACUGAAGAGUGUGAAAGAGCUGCUGGGGAUCACC

AUCAUGGAAAGAAGCAGCUUCGAGAAGAAUCCCAUCGACUUUCUGGAAGCCAAGGGC

UACAAAGAAGUGAAAAAGGACCUGAUCAUCAAGCUGCCUAAGUACUCCCUGUUCGAG

CUGGAAAACGGCCGGAAGAGAAUGCUGGCCUCUGCCGGCGAACUGCAGAAGGGAAAC

GAACUGGCCCUGCCCUCCAAAUAUGUGAACUUCCUGUACCUGGCCAGCCACUAUGAGA

AGCUGAAGGGCUCCCCCGAGGAUAAUGAGCAGAAACAGCUGUUUGUGGAACAGCACA

AGCACUACCUGGACGAGAUCAUCGAGCAGAUCAGCGAGUUCUCCAAGAGAGUGAUCC

UGGCCGACGCUAAUCUGGACAAAGUGCUGUCCGCCUACAACAAGCACCGGGAUAAGCC

CAUCAGAGAGCAGGCCGAGAAUAUCAUCCACCUGUUUACCCUGACCAAUCUGGGAGCC

CCUGCCGCCUUCAAGUACUUUGACACCACCAUCGACCGGAAGAGGUACACCAGCACCA

AAGAGGUGCUGGACGCCACCCUGAUCCACCAGAGCAUCACCGGCCUGUACGAGACACG

GAUCGACCUGUCUCAGCUGGGAGGCGAC (*AAAAGGCCGGCGGCCACGAAAAAGGCCGGCC*

*AGGCAAAAAGAAAAAGUGA*GGUACCGUCGCACACAUCCUAUUUGGGCCUAGCAACCAAC

*AGUAUG*) AAUCCAUUGCACUCCGGAUUU (*GUCACGGUUCU*UCGACAAUCAACCUCUGG

AUUACAAAAUUUGUGAAAGAUUGACUGGUAUUCUUAACUAUGUUGCUCCUUUUACG

CUAUGUGGAUACGCUGCUUUAAUGCCUUUGUAUCAUGCUAUUGCUUCCCGUAUGG

CUUUCAUUUUCUCCUCCUUGUAUAAAUCCUGGUUGCUGUCUCUUUAUGAGGAGUUG

-continued

UGGCCCGUUGUCAGGCAACGUGGCGUGGUGUGCACUGUGUUUGCUGACGCAACCC

CCACUGGUUGGGGCAUUGCCACCACCUGUCAGCUCCUUUCCGGGACUUUCGCUUU

CCCCCUCCCUAUUGCCACGGCGGAACUCAUCGCCGCCUGCCUUGCCCGCUGCUGG

ACAGGGGCUCGGCUGUUGGGCACUGACAAUUCCGUGGUGUUGUCGGGGAAGCUGA

CGUCCUUUCCAUGGCUGCUCGCCUGUGUUGCCACCUGGAUUCUGCGCGGGACGUC

CUUCUGCUACGUCCCUUCGGCCCUCAAUCCAGCGGACCUUCCUUCCCGCGGCCUG

CUGCCGGCUCUGCGGCCUCUUCCGCGUCUUCGCCUUCGCCCUCAGACGAGUCGGA

UCUCCCUUUGGGCCGCCUCCCCGCCUGGAAUUCG)

SEQ ID NO: 378

FLAG-Cas9-mnb-WPRE

GGCUCGUGUAGCUCAUUAGCUCCGAGCC(*UAGGAUUACUGCUCGGUGACUUAUAAUCAU*

*CCUCCCCGCCACC*AUGGACUAUAAGGACCACGACGGAGACUACAAGGAUCAUGAUA

UUGAUUACAAAGACGAUGACGAUAAGAUGGCCCCAAAGAAGAAGCGGAAGGUC)GGUA

UCCACGGAGUCCCAGCAGCCGACAAGAAGUACAGCAUCGGCCUGGACAUCGGCACCAA

CUCUGUGGGCUGGGCCGUGAUCACCGACGAGUACAAGGUGCCCAGCAAGAAAUUCAA

GGUGCUGGGCAACACCGACCGGCACAGCAUCAAGAAGAACCUGAUCGGAGCCCUGCUG

UUCGACAGCGGCGAAACAGCCGAGGCCACCCGGCUGAAGAGAACCGCCAGAAGAAGAU

ACACCAGACGGAAGAACCGGAUCUGCUAUCUGCAAGAGAUCUUCAGCAACGAGAUGG

CCAAGGUGGACGACAGCUUCUUCCACAGACUGGAAGAGUCCUUCCUGGUGGAAGAGG

AUAAGAAGCACGAGCGGCACCCCAUCUUCGGCAACAUCGUGGACGAGGUGGCCUACCA

CGAGAAGUACCCCACCAUCUACCACCUGAGAAAGAAACUGGUGGACAGCACCGACAAG

GCCGACCUGCGGCUGAUCUAUCUGGCCCUGGCCCACAUGAUCAAGUUCCGGGGCCACU

UCCUGAUCGAGGGCGACCUGAACCCCGACAACAGCGACGUGGACAAGCUGUUCAUCCA

GCUGGUGCAGACCUACAACCAGCUGUUCGAGGAAAACCCCAUCAACGCCAGCGGCGUG

GACGCCAAGGCCAUCCUGUCUGCCAGACUGAGCAAGAGCAGACGGCUGGAAAAUCUGA

UCGCCCAGCUGCCCGGCGAGAAGAAGAAUGGCCUGUUCGGAAACCUGAUUGCCCUGAG

CCUGGGCCUGACCCCCAACUUCAAGAGCAACUUCGACCUGGCCGAGGAUGCCAAACUG

CAGCUGAGCAAGGACACCUACGACGACGACCUGGACAACCUGCUGGCCCAGAUCGGCG

ACCAGUACGCCGACCUGUUUCUGGCCGCCAAGAACCUGUCCGACGCCAUCCUGCUGAG

CGACAUCCUGAGAGUGAACACCGAGAUCACCAAGGCCCCCCUGAGCGCCUCUAUGAUC

AAGAGAUACGACGAGCACCACCAGGACCUGACCCUGCUGAAAGCUCUCGUGCGGCAGC

AGCUGCCUGAGAAGUACAAAGAGAUUUUCUUCGACCAGAGCAAGAACGGCUACGCCG

GCUACAUUGACGGCGGAGCCAGCCAGGAAGAGUUCUACAAGUUCAUCAAGCCCAUCCU

GGAAAAGAUGGACGGCACCGAGGAACUGCUCGUGAAGCUGAACAGAGAGGACCUGCU

GCGGAAGCAGCGGACCUUCGACAACGGCAGCAUCCCCCACCAGAUCCACCUGGGAGAG

CUGCACGCCAUUCUGCGGCGGCAGGAAGAUUUUUACCCCAUUCCUGAAGGACAACCGGG

AAAAGAUCGAGAAGAUCCUGACCUUCCGCAUCCCCUACUACGUGGGCCCUCUGGCCAG

GGGAAACAGCAGAUUCGCCUGGAUGACCAGAAAGAGCGAGGAAACCAUCACCCCCUGG

AACUUCGAGGAAGUGGUGGACAAGGGCGCUUCCGCCCAGAGCUUCAUCGAGCGGAUG

ACCAACUUCGAUAAGAACCUGCCCAACGAGAAGGUGCUGCCCAAGCACAGCCUGCUGU

ACGAGUACUUCACCGUGUAUAACGAGCUGACCAAAGUGAAAUACGUGACCGAGGGAA

-continued

```
UGAGAAAGCCCGCCUUCCUGAGCGGCGAGCAGAAAAAGGCCAUCGUGGACCUGCUGUU

CAAGACCAACCGGAAAGUGACCGUGAAGCAGCUGAAAGAGGACUACUUCAAGAAAAU

CGAGUGCUUCGACUCCGUGGAAAUCUCCGGCGUGGAAGAUCGGUUCAACGCCUCCCUG

GGCACAUACCACGAUCUGCUGAAAAUUAUCAAGGACAAGGACUUCCUGGACAAUGAG

GAAAACGAGGACAUUCUGGAAGAUAUCGUGCUGACCCUGACACUGUUUGAGGACAGA

GAGAUGAUCGAGGAACGGCUGAAAACCUAUGCCCACCUGUUCGACGACAAAGUGAUG

AAGCAGCUGAAGCGGCGGAGAUACACCGGCUGGGGCAGGCUGAGCCGGAAGCUGAUC

AACGGCAUCCGGGACAAGCAGUCCGGCAAGACAAUCCUGGAUUUCCUGAAGUCCGACG

GCUUCGCCAACAGAAACUUCAUGCAGCUGAUCCACGACGACAGCCUGACCUUUAAAGA

GGACAUCCAGAAAGCCCAGGUGUCCGGCCAGGGCGAUAGCCUGCACGAGCACAUUGCC

AAUCUGGCCGGCAGCCCCGCCAUUAAGAAGGGCAUCCUGCAGACAGUGAAGGUGGUG

GACGAGCUCGUGAAAGUGAUGGGCCGGCACAAGCCCGAGAACAUCGUGAUCGAAAUG

GCCAGAGAGAACCAGACCACCCAGAAGGGACAGAAGAACAGCCGCGAGAGAAUGAAG

CGGAUCGAAGAGGGCAUCAAAGAGCUGGGCAGCCAGAUCCUGAAAGAACACCCCGUG

GAAAACACCCAGCUGCAGAACGAGAAGCUGUACCUGUACUACCUGCAGAAUGGGCGG

GAUAUGUACGUGGACCAGGAACUGGACAUCAACCGGCUGUCCGACUACGAUGUGGAC

CAUAUCGUGCCUCAGAGCUUUCUGAAGGACGACUCCAUCGACAACAAGGUGCUGACCA

GAAGCGACAAGAACCGGGGCAAGAGCGACAACGUGCCCUCCGAAGAGGUCGUGAAGA

AGAUGAAGAACUACUGGCGGCAGCUGCUGAACGCCAAGCUGAUUACCCAGAGAAAGU

UCGACAAUCUGACCAAGGCCGAGAGAGGCGGCCUGAGCGAACUGGAUAAGGCCGGCU

UCAUCAAGAGACAGCUGGUGGAAACCCGGCAGAUCACAAAGCACGUGGCACAGAUCCU

GGACUCCCGGAUGAACACUAAGUACGACGAGAAUGACAAGCUGAUCCGGGAAGUGAA

AGUGAUCACCCUGAAGUCCAAGCUGGUGUCCGAUUUCCGGAAGGAUUUCCAGUUUUA

CAAAGUGCGCGAGAUCAACAACUACCACCACGCCCACGACGCCUACCUGAACGCCGUC

GUGGGAACCGCCCUGAUCAAAAAGUACCCUAAGCUGGAAAGCGAGUUCGUGUACGGC

GACUACAAGGUGUACGACGUGCGGAAGAUGAUCGCCAAGAGCGAGCAGGAAAUCGGC

AAGGCUACCGCCAAGUACUUCUUCUACAGCAACAUCAUGAACUUUUUCAAGACCGAGA

UUACCCUGGCCAACGGCGAGAUCCGGAAGCGGCCUCUGAUCGAGACAAACGGCGAAAC

CGGGGAGAUCGUGUGGGAUAAGGGCCGGGAUUUUGCCACCGUGCGGAAAGUGCUGAG

CAUGCCCCAAGUGAAUAUCGUGAAAAAGACCGAGGUGCAGACAGGCGGCUUCAGCAA

AGAGUCUAUCCUGCCCAAGAGGAACAGCGAUAAGCUGAUCGCCAGAAAGAAGGACUG

GGACCCUAAGAAGUACGGCGGCUUCGACAGCCCCACCGUGGCCUAUUCUGUGCUGGUG

GUGGCCAAAGUGGAAAAGGGCAAGUCCAAGAAACUGAAGAGUGUGAAAGAGCUGCUG

GGGAUCACCAUCAUGGAAAGAAGCAGCUUCGAGAAGAAUCCCAUCGACUUUCUGGAA

GCCAAGGGCUACAAAGAAGUGAAAAAGGACCUGAUCAUCAAGCUGCCUAAGUACUCC

CUGUUCGAGCUGGAAAACGGCCGGAAGAGAAUGCUGGCCUCUGCCGGCGAACUGCAG

AAGGGAAACGAACUGGCCCUGCCCUCCAAAUAUGUGAACUUCCUGUACCUGGCCAGCC

ACUAUGAGAAGCUGAAGGGCUCCCCCGAGGAUAAUGAGCAGAAACAGCUGUUUGUGG

AACAGCACAAGCACUACCUGGACGAGAUCAUCGAGCAGAUCAGCGAGUUCUCCAAGAG

AGUGAUCCUGGCCGACGCUAAUCUGGACAAAGUGCUGUCCGCCUACAACAAGCACCGG

GAUAAGCCCAUCAGAGAGCAGGCCGAGAAUAUCAUCCACCUGUUUACCCUGACCAAUC
```

-continued

UGGGAGCCCCUGCCGCCUUCAAGUACUUUGACACCACCAUCGACCGGAAGAGGUACAC

CAGCACCAAAGAGGUGCUGGACGCCACCCUGAUCCACCAGAGCAUCACCGGCCUGUAC

GAGACACGGAUCGACCUGUCUCAGCUGGGAGGCGAC (AAAAGGCCGGCGGCCACGAAAAA

GGCCGGCCAGGCAAAAAAGAAAAAGUGA*GUCGCACACAUCCUAUUUGGGCCUAGCAACCA*

*ACAGUAUG*) GGCUCGUGUAGCUCAUUAGCUCCGAGCC (*GUCACGGUUCU*UCGACAAUCA

ACCUCUGGAUUACAAAAUUUGUGAAAGAUUGACUGGUAUUCUUAACUAUGUUGCUC

CUUUUACGCUAUGUGGAUACGCUGCUUUAAUGCCUUUGUAUCAUGCUAUUGCUUCC

CGUAUGGCUUUCAUUUUCUCCUCCUUGUAUAAAUCCUGGUUGCUGUCUCUUUAUGA

GGAGUUGUGGCCCGUUGUCAGGCAACGUGGCGUGGUGUGCACUGUGUUUGCUGAC

GCAACCCCCACUGGUUGGGGCAUUGCCACCACCUGUCAGCUCCUUUCCGGGACUU

UCGCUUUCCCCCUCCCUAUUGCCACGGCGGAACUCAUCGCCGCCUGCCUUGCCCG

CUGCUGGACAGGGGCUCGGCUGUUGGGCACUGACAAUUCCGUGGUGUUGUCGGGG

AAGCUGACGUCCUUUCCAUGGCUGCUCGCCUGUGUUGCCACCUGGAUUCUGCGCG

GGACGUCCUUCUGCUACGUCCCUUCGGCCCUCAAUCCAGCGGACCUUCCUUCCCG

CGGCCUGCUGCCGGCUCUGCGGCCUCUUCCGCGUCUUCGCCUUCGCCCUCAGACG

AGUCGGAUCUCCCUUUGGGCCGCCUCCCCGCCUGGAAUUCG)

In all embodiments disclosed herein, the one or more RNAs encoding a DNA binding protein or the one or more mRNA encoding a Class 2 Cas protein encode a DNA binding protein or a Class 2 Cas protein may include any other domains as useful for an intended purpose, including but not limited to a nuclear localization sequence (NLS). Additional useful domains that could be added to Cas9 include deaminase domains, transcriptional regulation domains, epigenetic modification domains, fluorescent protein tags, etc. See, for example, Nat Rev Mol Cell Biol. 2016 January; 17(1): 5-15.

The structural sequence for use in the gRNAs of these second and third aspects will depend on the specific Class 2 Cas protein that is either encoded by the mRNA (second aspect) or that is present in the RNP (third aspect). It is well within the level of those of skill in the art to identify the appropriate structural sequence in light of the Class 2 Cas protein, or mRNA encoding a Class 2 Cas protein, to be used in the compositions. In various non-limiting embodiments, the structural sequence comprises or consists of a sequence that is at least 50%, 55%, 60%, 65%, 70%, 75%, 80%, 85%, 90%, 95%, 96%, 97%, 98%, 99%, or 100% identical over its length to the nucleic acid sequence selected from the group consisting of SEQ ID NOS:332-335.

(SEQ ID NO: 332; particularly for use with
Sp Cas9)
GUUUAAGAGCUA-N-UGCUGGAAACAGCAUAGCAAGUUUAAAUAAGG
CUAGUCCGUUAUCAACUUGAAAAAGUGGCACCGAGUCGGUGC (SEQ ID NO: 333; particularly for use with
Sa Cas9)
GUUUUAGUACUCUG-N-GAAACAGAAUCUACUAAAACAAGGCAAAAU
GCCGUGUUUAUCUCGUCAACUUGUUGGCGAGA (SEQ ID NO: 334; particularly for use with
Lachnospiraceae CRISPR-Cas system (Cpf1))
AAUUUCUACUC-N-UUGUAGAU (SEQ ID NO: 335; particularly for use with
Acidaminococcus CRISPR-Cas system (Cpf1)
AAUUUCUACUAA-N-GUGUAGAU wherein N is absent or comprises or consists of an RNA packaging sequence, such as those described herein.

In one embodiment N is absent. In another embodiment, N is present, and the RNA packaging sequence comprises or consists of a sequence that is at least 50%, 55%, 60%, 65%, 70%, 75%, 80%, 85%, 90%, 95%, 96%, 97%, 98%, 99%, or 100% identical over its length to the nucleic acid sequence selected from the group consisting of SEQ ID NOS: 204-207, and 329.

The guide sequences for use in the gRNAs of these second and third aspects will depend on the specific nucleic acid to be targeted in a recipient cell when the compositions are used. It is well within the level of those of skill in the art to determine an appropriate guide sequences to be used in the gRNAs disclosed herein.

The subcomponents of the gRNA may be arranged as deemed appropriate for a specific use. In one embodiment, the guide sequence is located 5' to the structural sequence in the gRNA, and the RNA packaging sequence is located 3' to the structural sequence in the gRNA. This embodiment is particularly compatible with Cas9 as the Class 2 Cas protein. In another embodiment, the guide sequence is located 3' to the structural sequence, and the RNA packaging sequence is located 5' to the structural sequence. This embodiment is particularly compatible with Cpf1 as the Class 2 Cas protein.

In another embodiment of the second and third aspects, the gRNA further comprises an RNA stabilization sequence (i.e.: that increases RNA stability). Any suitable RNA stabilization sequence may be used. In one non-limiting embodiment, the RNA stabilization sequence comprises or consists of the sequence of SEQ ID NO:336.

(SEQ ID NO: 366)
UCGACAAUCAACCUCUGGAUUACAAAAUUUGUGAAAGAUUGACUGGU

AUUCUUAACUAUGUUGCUCCUUUUACGCUAUGUGGAUACGCUGCUUU

AAUGCCUUUGUAUCAUGCUAUUGCUUCCCGUAUGGCUUUCAUUUUCU

CCUCCUUGUAUAAAUCCUGGUUGCUGUCUCUUUAUGAGGAGUUGUGG

CCCGUUGUCAGGCAACGUGGCGUGGUGUGCACUGUGUUUGCUGACGC

AACCCCCACUGGUUGGGGCAUUGCCACCACCUGUCAGCUCCUUUCCG

GGACUUUCGCUUUCCCCUCCCUAUUGCCACGGCGGAACUCAUCGCC

GCCUGCCUUGCCCGCUGCUGGACAGGGGCUCGGCUGUUGGGCACUGA

CAAUUCCGUGGUGUUGUCGGGGAAGCUGACGUCCUUUCCAUGGCUGC

UCGCCUGUGUUGCCACCUGGAUUCUGCGCGGGACGUCCUUCUGCUAC

GUCCCUUCGGCCCUCAAUCCAGCGGACCUUCCUUCCCGCGGCCUGCU

GCCGGCUCUGCGGCCUCUUCCGCGUCUUCGCCUUCGCCCUCAGACGA

GUCGGAUCUCCCUUUGGGCCGCCUCCCCGCCUGGAAUUCG

In various non-limiting embodiments of the second and third aspects, the gRNA comprises or consists of a sequence that is at least 50%, 55%, 60%, 65%, 70%, 75%, 80%, 85%, 90%, 95%, 96%, 97%, 98%, 99%, or 100% identical over its length to the nucleic acid sequence selected from the group consisting of SEQ ID NOS:337-361 and 411-414. Guide sequences are shown in italics and can be replaced, in that they may be substituted for any other suitable guide sequence in light of a nucleic acid target of interest. For those sequences that recite a generic "RNA packaging sequence", the RNA packaging sequence may be any suitable packaging sequence, including but not limited to the RNA packaging sequence one of SEQ ID NO:204-207 and 329.

gRNA9op_3-u1a (CD18)
SEQ ID NO: 337
5'-X-*GCGACC*GUUUAAGAGCUAUGCUGGAAACAGCAUAGCAAGUUU
AAAUAAGGCUAGUCCGUUAUCAACUUGAAAAAGUGGCACCGAGUCGG
UGCAAUCCAUUGCACUCCGGAUUUU;
wherein X is an RNA Guide sequence and can be, for example GUGACGCUUUACCU (SEQ ID NO: 362);

gRNA9op_loop-u1a (CD18)
SEQ ID NO: 338
5'-X-GUUUAAGAGCUA<u>AAUCCAUUGCACUCCGGAUUUU</u>AGCAAGUU
UAAAUAAGGCUAGUCCGUUAUCAACUUGAAAAAGUGGCACCGAGUCG
GUGCUUUU;
wherein X is an RNA Guide sequence and can be, for example GUGACGCUUUACCUGCGACC (SEQ ID NO: 363);

gRNA10op_3-1g70
SEQ ID NO: 339
5'-X-GUUUAAGAGCUAUGCUGGAAACAGCAUAGCAAGUUUAAAUAA
GGCUAGUCCGUUAUCAACUUGAAAAAGUGGCACCGAGUCGGUGCGGU
<u>CUGGGCGCACUUCGGUGACGGUACAGGCC</u>UUUU;
wherein X is an RNA Guide sequence and can be, for example GGAGAUGUUUCAUGCUACAG (SEQ ID NO: 364);

gRNA10op_3-1g70-WPRE
SEQ ID NO: 340
5'-X-GUUUAAGAGCUAUGCUGGAAACAGCAUAGCAAGUUUAAAUAA
GGCUAGUCCGUUAUCAACUUGAAAAAGUGGCACCGAGUCGGUGCGG<u>U
CUGGGCGCACUUCGGUGACGGUACAGGCC</u>UCGACAAUCAACCUCUGG
AUUACAAAAUUUGUGAAAGAUUGACUGGUAUUCUUAACUAUGUUGCU
CCUUUUACGCUAUGUGGAUACGCUGCUUUAAUGCCUUUGUAUCAUGC
UAUUGCUUCCCGUAUGGCUUUCAUUUUCUCCUCCUUGUAUAAAUCCU
GGUUGCUGUCUCUUUAUGAGGAGUUGUGGCCCGUUGUCAGGCAACGU
GGCGUGGUGUGCACUGUGUUUGCUGACGCAACCCCCACUGGUUGGGG
CAUUGCCACCACCUGUCAGCUCCUUUCCGGGACUUUCGCUUUCCCCC
UCCCUAUUGCCACGGCGGAACUCAUCGCCGCCUGCCUUGCCCGCUGC
UGGACAGGGGCUCGGCUGUUGGGCACUGACAAUUCCGUGGUGUUGUC
GGGGAAGCUGACGUCCUUUCCAUGGCUGCUCGCCUGUGUUGCCACCU
GGAUUCUGCGCGGGACGUCCUUCUGCUACGUCCCUUCGGCCCUCAAU
CCAGCGGACCUUCCUUCCCGCGGCCUGCUGCCGGCUCUGCGGCCUCU
UCCGCGUCUUCGCCUUCGCCCUCAGACGAGUCGGAUCUCCCUUUGGG
CCGCCUCCCCGCCUGGAUUUU;
wherein X is an RNA Guide sequence and can be, for example GGAGAUGUUUCAUGCUACAG (SEQ ID NO: 364);

gRNA10op_3-2x1g70
SEQ ID NO: 341
5'-X-GUUUAAGAGCUAUGCUGGAAACAGCAUAGCAAGUUUAAAUAA
GGCUAGUCCGUUAUCAACUUGAAAAAGUGGCACCGAGUCGGUGCGGU
<u>CUGGGCGCACUUCGGUGACGGUACAGGCC</u>GCCUAGCAACCAACAGUA
UGGGUCUGGGCGCACUUCGGUGACGGUACAGGCCUUUU;
wherein X is an RNA Guide sequence and can be, for example GGAGAUGUUUCAUGCUACAG (SEQ ID NO: 364);

gRNA10op_3-2x1g70-dslinker
SEQ ID NO: 342
5'-X-GUUUAAGAGCUAUGCUGGAAACAGCAUAGCAAGUUUAAAUAA
GGCUAGUCCGUUAUCAACUUGAAAAAGUGGCACCGAGUCGGUGCGGU
<u>CUGGGCGCACUUCGGUGACGGUACAGGCC</u>GCCUAGCAACCAACAGUA
UGGGUCUGGGCGCACUUCGGUGACGGUACAGGCCCAUACUGUUGUUU
U;
wherein X is an RNA Guide sequence and can be, for example GGAGAUGUUUCAUGCUACAG (SEQ ID NO: 364);

gRNA10op_3-u1a
SEQ ID NO: 343
5'-X-GUUUAAGAGCUAUGCUGGAAACAGCAUAGCAAGUUUAAAUAA
GGCUAGUCCGUUAUCAACUUGAAAAAGUGGCACCGAGUCGGUGCAAU
CCAUUGCACUCCGGAUUUU;
wherein X is an RNA Guide sequence and can be, for example GGAGAUGUUUCAUGCUACAG (SEQ ID NO: 364);

gRNA10op_loop-1g70
SEQ ID NO: 344
5'-X-GUUUAAGAGCUAGGUCUGGGCGCACUUCGGUGACGGUACAGG

CCUAGCAAGUUUAAAUAAGGCUAGUCCGUUAUCAACUUGAAAAAGUG

GCACCGAGUCGGUGCUUUU;
wherein X is an RNA Guide sequence and can be,
for example GGAGAUGUUUCAUGCUACAG (SEQ ID NO:
364);

gRNA10op_loop-1g70-WPRE
SEQ ID NO: 345
5'-X-GUUUAAGAGCUAGGUCUGGGCGCACUUCGGUGACGGUACAGG

CCUAGCAAGUUUAAAUAAGGCUAGUCCGUUAUCAACUUGAAAAAGUG

GCACCGAGUCGGUGCUCGACAAUCAACCUCUGGAUUACAAAAUUUGU

GAAAGAUUGACUGGUAUUCUUAACUAUGUUGCUCCUUUUACGCUAUG

UGGAUACGCUGCUUUAAUGCCUUUGUAUCAUGCUAUUGCUUCCCGUA

UGGCUUUCAUUUUCUCCUCCUUGUAUAAAUCCUGGUUGCUGUCUCUU

UAUGAGGAGUUGUGGCCCGUUGUCAGGCAACGUGGCGUGGUGUGCAC

UGUGUUUGCUGACGCAACCCCCACUGGUUGGGGCAUUGCCACCACCU

GUCAGCUCCUUCCGGGACUUUCGCUUUCCCCUCCCUAUUGCCACG

GCGGAACUCAUCGCCGCCUGCCUUGCCCGCUGCUGGACAGGGGCUCG

GCUGUUGGGCACUGACAAUUCCGUGGUGUUGUCGGGGAAGCUGACGU

CCUUUCCAUGGCUGCUCGCCUGUGUUGCCACCUGGAUUCUGCGCGGG

ACGUCCUUCUGCUACGUCCCUUCGGCCCUCAAUCCAGCGGACCUUCC

UUCCCGCGGCCUGCUGCCGGCUCUGCGGCCUCUUCCGCGUCUUCGCC

UUCGCCCUCAGACGAGUCGGAUCUCCCUUUGGGCCGCCUCCCCGCCU

GGAUUUU;
wherein X is an RNA Guide sequence and can be,
for example GGAGAUGUUUCAUGCUACAG (SEQ ID NO:
364);

gRNA10op_loop-u1a
SEQ ID NO: 346
5'-X-GUUUAAGAGCUAAAUCCAUUGCACUCCGGAUUUUAGCAAGUU

UAAAUAAGGCUAGUCCGUUAUCAACUUGAAAAAGUGGCACCGAGUCG

GUGCUUUU;
wherein X is an RNA Guide sequence and can be,
for example GGAGAUGUUUCAUGCUACAG (SEQ ID NO:
364);

gRNA64op_loop-1g70 (mPD1)
SEQ ID NO: 347
5'-X-GUUUAAGAGCUAGGUCUGGGCGCACUUCGGUGACGGUACAGG

CCUAGCAAGUUUAAAUAAGGCUAGUCCGUUAUCAACUUGAAAAAGUG

GCACCGAGUCGGUGCUUUU;
wherein X is an RNA Guide sequence and can be,
for example GUGAAUGACCAGGGUACCUGC (SEQ ID NO:
365);

gRNA65op_loop-1g70 (mPD1)
SEQ ID NO: 348
5'-X-GUUUAAGAGCUAGGUCUGGGCGCACUUCGGUGACGGUACAGG

CCUAGCAAGUUUAAAUAAGGCUAGUCCGUUAUCAACUUGAAAAAGUG

GCACCGAGUCGGUGCUUUU;
wherein is an RNA Guide sequence and can be,
for example GACAGCCCAAGUGAAUGACCA (SEQ ID NO:
366);

gRNA10_3-1g70
SEQ ID NO: 349
5'-X-GUUUUAGAGCUAGAAAUAGCAAGUUAAAAUAAGGCUAGUCCG

UUAUCAACUUGAAAAAGUGGCACCGAGUCGGUGCGGUCUGGGCGCAC

UUCGGUGACGGUACAGGCC(UUUUUU);
wherein X is an RNA Guide sequence and can be,
for example GGAGAUGUUUCAUGCUACAG (SEQ ID NO:
364);

gRNA10_loop-1g70
SEQ ID NO: 350
5'-X-GUUUUAGAGCUAGGUCUGGGCGCACUUCGGUGACGGUACAGG

CCUAGCAAGUUAAAAUAAGGCUAGUCCGUUAUCAACUUGAAAAAGUG

GCACCGAGUCGGUGC(UUUUUU);
wherein X is an RNA Guide sequence and can be,
for example GGAGAUGUUUCAUGCUACAG (SEQ ID NO:
364);

Sa gRNA sequence
SEQ ID NO: 351
5'-X-GUUUUAGUACUCUGGAAACAGAAUCUACUAAAACAAGGCAAA

AUGCCGUGUUUAUCUCGUCAACUUGUUGGCGAGA(UUUUUU);
wherein X is an RNA Guide sequence;

Sa gRNA sequence with RNA packaging sequence
inserted into its loop
SEQ ID NO: 352
5'-X-GUUUUAGUACUCUG-N-GAAACAGAAUCUACUAAAACAAGGC AAAAUGCCGUGUUUAUCUCGUCAACUUGUUGGCGAGA(UUUUUU);
wherein X is an RNA guide sequence, and N is an
RNA packaging sequence;

Sa gRNA sequence with RNA packaging sequence
inserted at 3' end
SEQ ID NO: 353
5'-X-GUUUUAGUACUCUGGAAACAGAAUCUACUAAAACAAGGCAAA AUGCCGUGUUUAUCUCGUCAACUUGUUGGCGAGA-N-(UUUUUU);
wherein X is an RNA Guide sequence, and N is an
RNA packaging sequence;

*Acidaminococcus* sp. BV3L6 gRNA (underlined C
can also be a G)
SEQ ID NO: 354
5'-AAUUUCUACUCUUGUAGAU-X;
wherein X is an RNA Guide sequence;

*Acidaminococcus* sp. BV3L6 gRNA with RNA
packaging sequence in loop
SEQ ID NO: 355
5'-AAUUUCUACUC-N-UUGUAGAU-X;
wherein X is an RNA Guide sequence, and N is an
RNA packaging sequence;

*Acidaminococcus* sp. BV3L6 gRNA with RNA
packaging sequence at 5' end
SEQ ID NO: 356
5'-N-AAUUUCUACUCUUGUAGAU-X;
wherein X is an RNA Guide sequence, and N is an
RNA packaging sequence;

*Acidaminococcus* sp. BV3L6 gRNA with RNA
packaging sequence at 3' end
SEQ ID NO: 357
5'-AAUUUCUACUCUUGUAGAU-X-N;
wherein X is an RNA Guide sequence, and N is an
RNA packaging sequence;

*Lachnospiraceae* gRNA
SEQ ID NO: 358
5'-AAUUUCUACUAAGUGUAGAU-X;
wherein X is an RNA Guide sequence;

```
Lachnospiraceae gRNA with RNA packaging
sequence in loop
                                    SEQ ID NO: 359
5'-AAUUUCUACUAA-N-GUGUAGAU-X;
wherein X is an RNA Guide sequence, and N is an
RNA packaging sequence;

Lachnospiraceae gRNA with RNA packaging
sequence at 5' end
                                    SEQ ID NO: 360
5'-N-AAUUUCUACUAAGUGUAGAU-X;
wherein X is an RNA Guide sequence, and N is an
RNA packaging sequence;

Lachnospiraceae gRNA with RNA packaging
sequence at 3' end
                                    SEQ ID NO: 361
AAUUUCUACUAAGUGUAGAU-X-N;
wherein X is an RNA Guide sequence, and N is an
RNA packaging sequence;

gRNA71op_3-u1a (targets TCRa)
                                    SEQ ID NO: 411
5'-X-GUUUAAGAGCUAUGCUGGAAACAGCAUAGCAAGUUUAAAUAA

GGCUAGUCCGUUAUCAACUUGAAAAAGUGGCACCGAGUCGGUGCAAU

CCAUUGCACUCCGGA(UUUU);
wherein X is an RNA Guide sequence and can be,
for example GUCAAGAGCAACAGUGCUG (SEQ ID NO:
409);

gRNA71op_loop-u1a (targets TCRa)
                                    SEQ ID NO: 412
5'-X-GUUUAAGAGCUAAAUCCAUUGCACUCCGGAUUUUAGCAAGUU

UAAAUAAGGCUAGUCCGUUAUCAACUUGAAAAAGUGGCACCGAGUCG

GUGC(UUUU);
wherein X is an RNA Guide sequence and can be,
for example GUCAAGAGCAACAGUGCUG (SEQ ID NO:
409);

gRNA71op_3-1g70 (targets TCRa)
                                    SEQ ID NO: 413
5'-X-GUUUAAGAGCUAUGCUGGAAACAGCAUAGCAAGUUUAAAUAA

GGCUAGUCCGUUAUCAACUUGAAAAAGUGGCACCGAGUCGGUGCGGU

CUGGGCGCACUUCGGUGACGGUACAGGCC(UUUU);
wherein X is an RNA Guide sequence and can be,
for example GUCAAGAGCAACAGUGCUG (SEQ ID NO:
409);
and gRNA71op_loop-1g70 (targets TCRa)
                                    SEQ ID NO: 414
5'-X-GUUUAAGAGCUAGGUCUGGGCGCACUUCGGUGACGGUACAGG

CCUAGCAAGUUUAAAUAAGGCUAGUCCGUUAUCAACUUGAAAAAGUG

GCACCGAGUCGGUGC(UUUU);
wherein X is an RNA Guide sequence and can be,
for example GUCAAGAGCAACAGUGCUG (SEQ ID NO:
409).
```

Any guide sequence can be used in a gRNA, depending on the target nucleic acid. In 50 exemplary, non-limiting embodiments, the guide sequences may be selected from the group consisting of SEQ ID NOs:362-365 or 407-410. For example, GGAGAUGUUUCAUGCUACAG Guide sequence RNA10 targets AIM2 (SEQ ID NO:364), GUGAAUGACCAGGGUACCUGC Guide sequence RNA64 targets PD1 (SEQ ID NO:365), GACAGCCCAAGUGAAUGACCA Guide sequence RNA65 targets PD1 (SEQ ID NO:366), GAAGCGCCUGGCAGUGUACC Guide sequence apoE4 targets apolipoprotein E gene variant apoE4 (SEQ ID NO:407), GUGACGCUUUACCUGCGACC Guide sequence RNA9 targets CD18 (SEQ ID NO:408), GUCAAGAGCAACAGUGCUG Guide sequence RNA71 targets TCRα (SEQ ID NO:409), GGCCCAGACUGAGCACGUGA Guide sequence HEK3 targets a sequence in HEK293T cells (SEQ ID NO:410).

As used herein, the O domain is any polypeptide region (contiguous or non-contiguous) that is capable of driving self-assembly of the recombinant polypeptides and/or oligomeric substructures of the compositions of the present disclosure via non-covalent interactions. The O domains are non-natural protein interfaces, in that they are designed and are not naturally occurring. The O domains may utilize any suitable non-covalent interaction(s) to drive self-interaction of the recombinant polypeptides and/or oligomeric substructures, including but not limited to one or more of electrostatic interactions, π-effects, van der Waals forces, hydrogen bonding, and hydrophobic effects. In one embodiment, where the oligomeric substructures are formed from a single protein, the one or more O interfaces are identical.

Based on the disclosure herein, it is well within the level of those of skill in the art to identify O interfaces suitable for use in producing the multimeric assemblies of the disclosure. An O domain for use in the present disclosure can be any polypeptide region (contiguous or non-contiguous) that is capable of driving self-assembly of the proteins and/or oligomeric substructures of the assemblies of the present disclosure via non-covalent interactions. The O domains are non-natural protein interfaces, in that they are designed and are not naturally occurring. As will be known to those of skill in the art, an O domain can be demonstrated to perform the function of driving self-assembly using a variety of standard biochemical and biophysical techniques for evaluating the apparent size of multi-subunit protein assemblies. Such assays include but are not limited to native (non-denaturing) polyacrylamide gel electrophoresis, size exclusion chromatography, multi-angle light scattering, dynamic light scattering, analytical ultracentrifugation, small-angle X-ray scattering, visualization by electron microscopy or cryo-electron microscopy, atomic force microscopy, and high-resolution structure determination by X-ray crystallography. In the case of multimeric assemblies that comprise a first oligomeric protein substructure and a second oligomeric protein substructure, techniques commonly used to identify interactions between two different proteins can additionally be used to demonstrate the ability of an O domain to drive self-assembly of the first and second proteins. Such techniques include but are not limited to co-precipitation or co-purification of the two proteins, isothermal titration calorimetry, fluorescence resonance energy transfer-based techniques, and fluorescence anisotropy. In all cases, disruption of the amino acid residues comprising the non-natural protein-protein interface within the O domain by mutation, or deletion of the O domain, can provide valuable controls for evaluating the function of the O domain.

In various further embodiments, the O interface is present (contiguously or non-contiguously) in a polypeptide comprising or consisting of one of the following amino acid sequences, which are particularly useful in generating the assemblies of the first aspect of the disclosure:

| SEQ ID NO: 1 | | | |
|---|---|---|---|
| AA1 | M or absent | AA2 | ANY |
| AA3 | ANY | AA4 | A |
| AA5 | I | AA6 | G |
| AA7 | I | AA8 | L |

| SEQ ID NO: 1 | | | |
|---|---|---|---|
| AA9 | E | AA10 | L |
| AA11 | ANY | AA12 | S |
| AA13 | I | AA14 | A |
| AA15 | A | AA16 | G |
| AA17 | M | AA18 | E |
| AA19 | L | AA20 | G |
| AA21 | D | AA22 | A |
| AA23 | M | AA24 | L |
| AA25 | ANY | AA26 | S |
| AA27 | A | AA28 | ANY |
| AA29 | V | AA30 | ANY |
| AA31 | L | AA32 | L |
| AA33 | V | AA34 | S |
| AA35 | ANY | AA36 | T |
| AA37 | I | AA38 | ANY |
| AA39 | ANY | AA40 | G |
| AA41 | ANY | AA42 | F |
| AA43 | L | AA44 | L |
| AA45 | M | AA46 | L |
| AA47 | G | AA48 | G |
| AA49 | ANY | AA50 | ANY |
| AA51 | G | AA52 | A |
| AA53 | I | AA54 | Q |
| AA55 | ANY | AA56 | A |
| AA57 | I | AA58 | E |
| AA59 | T | AA60 | G |
| AA61 | T | AA62 | S |
| AA63 | Q | AA64 | A |
| AA65 | G | AA66 | E |
| AA67 | L | AA68 | ANY |
| AA69 | ANY | AA70 | ANY |
| AA71 | S | AA72 | ANY |
| AA73 | V | AA74 | L |
| AA75 | ANY | AA76 | ANY |
| AA77 | I | AA78 | ANY |
| AA79 | ANY | AA80 | S |
| AA81 | V | AA82 | L |
| AA83 | ANY | AA84 | A |
| AA85 | I | AA86 | ANY |
| AA87 | ANY | AA88 | ANY |
| AA89 | N | AA90 | ANY |
| AA91 | V | AA92 | ANY |
| AA93 | ANY | AA94 | ANY |
| AA95 | ANY | AA96 | A |
| AA97 | V | AA98 | G |
| AA99 | I | AA100 | V |
| AA101 | E | AA102 | T |
| AA103 | ANY | AA104 | S |
| AA105 | V | AA106 | A |
| AA107 | A | AA108 | C |
| AA109 | I | AA110 | S |
| AA111 | A | AA112 | A |
| AA113 | D | AA114 | ANY |
| AA115 | A | AA116 | V |
| AA117 | ANY | AA118 | G |
| AA119 | S | AA120 | ANY |
| AA121 | V | AA122 | T |
| AA123 | L | AA124 | V |
| AA125 | R | AA126 | V |
| AA127 | ANY | AA128 | M |
| AA129 | A | AA130 | ANY |
| AA131 | G | AA132 | I |
| AA133 | ANY | AA134 | G |
| AA135 | K | AA136 | C |
| AA137 | Y | AA138 | M |
| AA139 | V | AA140 | V |
| AA141 | A | AA142 | G |
| AA143 | ANY | AA144 | V |
| AA145 | S | AA146 | D |
| AA147 | V | AA148 | A |
| AA149 | L | AA150 | A |
| AA151 | V | AA152 | T |
| AA153 | V | AA154 | A |
| AA155 | S | AA156 | S |
| AA157 | S | AA158 | A |
| AA159 | G | AA160 | A |
| AA161 | Y | AA162 | ANY |
| AA163 | L | AA164 | L |
| AA165 | V | AA166 | Y |
| AA167 | A | AA168 | S |
| AA169 | L | AA170 | I |
| AA171 | ANY | AA172 | ANY |
| AA173 | P | AA174 | ANY |
| AA175 | ANY | AA176 | A |
| AA177 | M | AA178 | ANY |
| AA179 | ANY | AA180 | Q |
| AA181 | M | AA182 | V |
| AA183 | ANY | AA184 | ANY |

As used throughout this application, a "defined residue" means an amino acid position in the sequence listing that recites a specific amino acid residue. All undefined residues in SEQ ID NO: 1 (i.e., residues that do not include a defined residue) are present on the polypeptide surface, and thus can be substituted with a different amino acid as desired for a given purpose without disruption of the polypeptide structure that permits polypeptide self-assembly. All defined residues are present in the polypeptide interior, and thus can be modified only by conservative substitutions to maintain overall polypeptide structure to permit polypeptide self-assembly. As used here, "conservative amino acid substitution" means that:

hydrophobic amino acids (Ala, Cys, Gly, Pro, Met, Sce, Sme, Val, Ile, Leu) can only be substituted with other hydrophobic amino acids;

hydrophobic amino acids with bulky side chains (Phe, Tyr, Trp) can only be substituted with other hydrophobic amino acids with bulky side chains;

amino acids with positively charged side chains (Arg, His, Lys) can only be substituted with other amino acids with positively charged side chains;

amino acids with negatively charged side chains (Asp, Glu) can only be substituted with other amino acids with negatively charged side chains; and amino acids with polar uncharged side chains (Ser, Thr, Asn, Gln) can only be substituted with other amino acids with polar uncharged side chains.

For ease of review, Table 1 provides a representation of SEQ ID NO: 1, where the term "AA-" refers to the amino acid residue within SEQ ID NO: 1, and the term "any" means an undefined residue. As used herein, the amino acid residues are abbreviated as follows: alanine (Ala; A), asparagine (Asn; N), aspartic acid (Asp; D), arginine (Arg; R), cysteine (Cys; C), glutamic acid (Glu; E), glutamine (Gln; Q), glycine (Gly; G), histidine (His; H), isoleucine (Ile; I), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V). A residue in parentheses within the disclosed sequences means that the residue may be absent.

In one embodiment, an O interface polypeptide includes at least 2, 3, 4, 5, 6, 7, 8, 9, 10, or more amino acid substitutions relative to SEQ ID NO: 2 (3n79-wt).

(SEQ ID NO: 2)
(M)SQAIGILELTSIAKGMELGDAMLKSANVDLLVSKTICPGKFLL

MLGGDIGAIQQAIETGTSQAGEMLVDSLVLANIHPSVLPAISGLNS

VDKRQAVGIVETWSVAACISAADRAVKGSNVTLVRVHMAFGIGGKC

```
YMVVAGDVSDVNNAVTVASESAGEKGLLVYRSVIPRPHEAMWRQMV

EG
```

In one such embodiment, at least two of the following amino acid positions are changed relative to SEQ ID NO:2: AA14, AA67, AA148, AA149, AA156, AA160, AA161, AA167, and AA 169. In various embodiments, 2, 3, 4, 5, 6, 7, 8, or all 9 residues (AA14, AA67, AA148, AA149, AA156, AA160, AA161, AA167, and AA 169) in the polypeptides of this aspect of the disclosure are changed relative to SEQ ID NO:2.

In a further embodiment, the O interface-containing polypeptide includes no more than 100 defined residues as per SEQ ID NO: 1 are modified by a conservative amino acid substitution. In various further embodiments, no more than 90, 85, 80, 75, 70, 65, 60, 55, 50, 45, 40, 35, 30, 25, 30, 15, 10, 9, 8, 7, 6, 5, 4, 3, 2, or 1 defined residues as per SEQ ID NO:1 are modified by a conservative amino acid substitution. In a further embodiment, the O interface-containing polypeptide comprises or consists of SEQ ID NO: 1 with no defined residues modified by a conservative amino acid substitution.

In a further embodiment, the O interface-containing polypeptide comprises or consists of an amino acid sequence with at least 75% identity to the amino acid sequence of SEQ ID NO:3 (also referred to herein as "03-33").

```
                                                   (SEQ ID NO: 3)
(M)SQAIGILELTSIAAGMELGDAMLKSANVDLLVSKTISPGKFLL

MLGGDIGAIQQAIETGTSQAGELLVDSLVLANIHPSVLPAISGLNS

VDKRQAVGIVETWSVAACISAADRAVKGSNVTLVRVHMAFGIGGKC

YMVVAGDVSDVALAVTVASSSAGAYGLLVYASLIPRPHEAMWRQMV

EG
```

In various embodiments, the O interface-containing polypeptide comprises or consists of an amino acid sequence with at least 80%, 85%, 90%, 95%, 96%, 97%, 98%, or 99% identity to the amino acid sequence of SEQ ID NO:3. In each of these embodiments, it is understood that residues in SEQ ID NO:3 corresponding to defined residues in SEQ ID NO: 1 may only be substituted by conservative amino acid substitutions. In another embodiment, a polypeptide of the second aspect of the disclosure comprises or consists of the amino acid sequence of SEQ ID NO:3 (03-33), which is discussed by way of example herein.

In a further embodiment, the O interface-containing polypeptide comprises or consists of the amino acid sequence of SEQ ID NO:4, wherein any defined residue in SEQ ID NO:4 can be modified by a conservative amino acid substitution, and wherein the polypeptide does not comprise or consist of the amino acid sequence of SEQ ID NO: 8 (3ftt-wt). For ease of review, Table 2 provides a representation of SEQ ID NO:4, where the term "AA-" refers to the amino acid residue within SEQ ID NO:4, and the term "any" means an undefined residue.

TABLE 2

| (SEQ ID NO: 4) | | | |
|---|---|---|---|
| AA1 | M or absent | AA2 | ANY |
| AA3 | ANY | AA4 | ANY |
| AA5 | ANY | AA6 | ANY |

TABLE 2-continued

| (SEQ ID NO: 4) | | | |
|---|---|---|---|
| AA7 | ANY | AA8 | ANY |
| AA9 | ANY | AA10 | ANY |
| AA11 | K | AA12 | W |
| AA13 | ANY | AA14 | D |
| AA15 | A | AA16 | ANY |
| AA17 | F | AA18 | D |
| AA19 | ANY | AA20 | T |
| AA21 | ANY | AA22 | I |
| AA23 | N | AA24 | E |
| AA25 | R | AA26 | L |
| AA27 | R | AA28 | A |
| AA29 | K | AA30 | V |
| AA31 | I | AA32 | C |
| AA33 | F | AA34 | A |
| AA35 | L | AA36 | N |
| AA37 | H | AA38 | T |
| AA39 | N | AA40 | P |
| AA41 | S, V | AA42 | ANY |
| AA43 | T | AA44 | L, M |
| AA45 | K, M | AA46 | ANY |
| AA47 | K | AA48 | V |
| AA49 | L | AA50 | I |
| AA51 | D | AA52 | A |
| AA53 | L | AA54 | F |
| AA55 | Q | AA56 | T |
| AA57 | T | AA58 | ANY |
| AA59 | ANY | AA60 | N |
| AA61 | ANY | AA62 | S |
| AA63 | I | AA64 | S |
| AA65 | I | AA66 | P |
| AA67 | F | AA68 | D |
| AA69 | T | AA70 | D |
| AA71 | Y | AA72 | G |
| AA73 | W | AA74 | N |
| AA75 | ANY | AA76 | K |
| AA77 | L | AA78 | ANY |
| AA79 | ANY | AA80 | N |
| AA81 | V | AA82 | Y |
| AA83 | V | AA84 | N |
| AA85 | T | AA86 | N |
| AA87 | C | AA88 | Y |
| AA89 | F | AA90 | M |
| AA91 | D | AA92 | ANY |
| AA93 | G | AA94 | ANY |
| AA95 | I | AA96 | T |
| AA97 | ANY | AA98 | G |
| AA99 | D | AA100 | N |
| AA101 | V | AA102 | F |
| AA103 | I | AA104 | G |
| AA105 | P | AA106 | N |
| AA107 | C | AA108 | G |
| AA109 | F | AA110 | Y |
| AA111 | ANY | AA112 | A |
| AA113 | T | AA114 | ANY |
| AA115 | P | AA116 | ANY |
| AA117 | ANY | AA118 | ANY |
| AA119 | H | AA120 | H |
| AA121 | ANY | AA122 | N |
| AA123 | ANY | AA124 | G |
| AA125 | ANY | AA126 | E |
| AA127 | K | AA128 | A |
| AA129 | G | AA130 | ANY |
| AA131 | I | AA132 | H |
| AA133 | I | AA134 | G |
| AA135 | S | AA136 | N |
| AA137 | T | AA138 | W |
| AA139 | F | AA140 | G |
| AA141 | G | AA142 | H |
| AA143 | V | AA144 | A |
| AA145 | V | AA146 | L |
| AA147 | P | AA148 | ANY |
| AA149 | V | AA150 | T |
| AA151 | ANY | AA152 | G |
| AA153 | E | AA154 | G |
| AA155 | S | AA156 | V |
| AA157 | I | AA158 | G |
| AA159 | A | AA160 | G |
| AA161 | S | AA162 | V |

TABLE 2-continued (SEQ ID NO: 4)

| | | | |
|---|---|---|---|
| AA163 | ANY | AA164 | ANY |
| AA165 | K | AA166 | ANY |
| AA167 | ANY | AA168 | ANY |
| AA169 | P | AA170 | H |
| AA171 | S | AA172 | ANY |
| AA173 | A | AA174 | V |
| AA175 | ANY | AA176 | N |
| AA177 | ANY | AA178 | ANY |
| AA179 | ANY | AA180 | ANY |
| AA181 | ANY | AA182 | R |
| AA183 | ANY | AA184 | I |
| AA185 | ANY | AA186 | ANY |
| AA187 | D | AA188 | L |
| AA189 | P | AA190 | S |
| AA191 | E | AA192 | T |
| AA193 | L | AA194 | N |
| AA195 | D | AA196 | E |
| AA197 | T | AA198 | I |
| AA199 | K | | |

In one embodiment, the O interface-containing polypeptide includes at least 2, 3, 4, 5, 6, 7, 8, 9, 10, or more amino acid substitutions relative to SEQ ID NO: 5 (3ftt-wt) or SEQ ID NO: 6 (3n79-wt).

(SEQ ID NO: 5)
(M) TEKEKMLAEKWYDANFDQYLINERARAKDICFELNHTRPSATN

KRKELIDQLFQTTTDNVSISIPFDTDYGWNVKLGKNVYVNTNCYFM

DGGQITIGDNVFIGPNCGFYTATHPLNFHHRNEGFEKAGPIHIGSN

TWFGGHVAVLPGVTIGEGSVIGAGSVVTKDIPPHSLAVGNPCKVVR

KIDNDLPSETLNDETIK

In one such embodiment, at least two of the following amino acid positions are changed relative to SEQ ID NO:5: AA20, AA26, AA30, AA34, AA39, AA41, AA44, AA48, and AA 52. In various embodiments, 2, 3, 4, 5, 6, 7, 8, or all 9 residues (AA20, AA26, AA30, AA34, AA39, AA41, AA44, AA48, and AA 52) in the polypeptides of the second aspect of the disclosure are changed relative to SEQ ID NO:5.

In a further embodiment, the O interface-containing polypeptide includes no more than 100 defined residues as per SEQ ID NO:4 are modified by a conservative amino acid substitution. In various further embodiments, no more than 90, 85, 80, 75, 70, 65, 60, 55, 50, 45, 40, 35, 30, 25, 30, 15, 10, 9, 8, 7, 6, 5, 4, 3, 2, or 1 defined residues as per SEQ ID NO:4 are modified by a conservative amino acid substitution. In a further embodiment, the O interface-containing polypeptide comprises or consists of SEQ ID NO:4 with no defined residues modified by a conservative amino acid substitution.

In a further embodiment, the O interface-containing polypeptide comprises or consists of an amino acid sequence with at least 75% identity to an amino acid sequence selected from the group consisting of SEQ ID NO:9, SEQ ID NO: 7 (also referred to herein as "T3-08"), and SEQ ID NO:8 (also referred to herein as "T3-10").

T3-08
(SEQ ID NO: 7)
(M) TEKEKMLAEKWYDANFDQTLINERLRAKVICFALNHTNPSATL

KRKVLIDALFQTTTDNVSISIPFDTDYGWNVKLGKNVYVNTNCYFM

DGGQITIGDNVFIGPNCGFYTATHPLNFHHRNEGFEKAGPIHIGSN

TWFGGHVAVLPGVTIGEGSVIGAGSVVTKDIPPHSLAVGNPCKVVR

KIDNDLPSETLNDETIK

T3-10
(SEQ ID NO: 8)
(M) TEKEKMLAEKWYDANFDQTLINERLRAKVICFALNHTNPVATM

MRKVLIDALFQTTTDNVSISIPFDTDYGWNVKLGKNVYVNTNCYFM

DGGQITIGDNVFIGPNCGFYTATHPLNFHHRNEGFEKAGPIHIGSN

TWFGGHVAVLPGVTIGEGSVIGAGSVVTKDIPPHSLAVGNPCKVVR

KIDNDLPSETLNDETIK;
or SEQ ID NO: 9.

In various embodiments, the O interface-containing polypeptide comprises or consists of an amino acid sequence with at least 80%, 85%, 90%, 95%, 96%, 97%, 98%, or 99% identity to an amino acid sequence selected from the group consisting of SEQ ID NO:7, SEQ ID NO: 8, and SEQ ID NO: 9. In each of these embodiments, it is understood that residues in SEQ ID NO:7, 8, or 9 corresponding to defined residues in SEQ ID NO:4 may only be substituted by conservative amino acid substitutions. In another embodiment, the O interface-containing polypeptide comprises or consists of an amino acid sequence selected from the group consisting of SEQ ID NO:7, SEQ ID NO:8, and SEQ ID NO:9, which are discussed by way of example herein.

In another embodiment, the O domain-containing polypeptide comprises or consists of a polypeptide selected from SEQ ID NOS: 10-19, which are particularly useful in generating the assemblies of the second aspect of the disclosure.

In another embodiment, the O domain-containing polypeptide comprises or consists of a polypeptide selected from SEQ ID NOS: 22-51.

In another embodiment, the O domain-containing polypeptide comprises or consists of a polypeptide with at least 75%, 80%, 85%, 90%, 95%, 96%, 97%, 98%, 99%, or 100% identity to the amino acid sequence of SEQ ID NO: 20 (I3-01) or 304 (I3-01(M3I));

wherein the polypeptide includes at least 1, 2, 3, 4, 5, or more amino acid substitutions compared to SEQ NO: 21 (1wa3-wt).

(I3-01)
SEQ ID: 20
(M) KMEELFKKHKIVAVLRANSVEEAKKKALAVFLGGVHLIEITFT

VPDADTVIKELSFLKEMGAIIGAGTVTSVEQCRKAVESGAEFIVSP

HLDEEISQFCKEKGVFYMPGVMTPTELVKAMKLGHTILKLFPGEVV

GPQFVKAMKGPFPNVKFVPTGGVNLDNVCEWFKAGVLAVGVGSALV

KGTPVEVAEKAKAFVEKIRGCTE;
or (I3-01(M3I)
SEQ ID 304:
(M) KIEELFKKHKIVAVLRANSVEEAKKKALAVFLGGVHLIEITFT

VPDADTVIKELSFLKEMGAIIGAGTVTSVEQCRKAVESGAEFIVSP

HLDEEISQFCKEKGVFYMPGVMTPTELVKAMKLGHTILKLFPGEVV

-continued

```
GPQFVKAMKGPFPNVKFVPTGGVNLDNVCEWFKAGVLAVGVGSALV

KGTPVEVAEKAKAFVEKIRGCTE (1wa3-wt)
SEQ ID: 21
MKMEELFKKHKIVAVLRANSVEEAKEKALAVFEGGVHLIEITFTVP

DADTVIKELSFLKEKGAIIGAGTVTSVEQCRKAVESGAEFIVSPHL

DEEISQFCKEKGVFYMPGVMTPTELVKAMKLGHTILKLFPGEVVGP

QFVKAMKGPFPNVKFVPTGGVNLDNVCEWFKAGVLAVGVGSALVKG

TPDEVREKAKAFVEKIRGCTE.
```

An "M domain" for use in the present disclosure can be any suitable polypeptide that is capable of binding to a lipid bilayer via any suitable mechanism, including but not limited to non-covalently interacting with the lipid bilayer membrane. In various embodiments, such interactions may include but are not limited to interacting via specific binding pockets with the polar head groups of lipid molecules in the lipid bilayer, interacting electrostatically with charged polar head groups, interacting non-covalently with the hydrophobic interior of the lipid bilayer, or by harboring a chemical modification (non-limiting examples may be fatty acid or acylation modifications such as myristoylation) that interacts non-covalently with the lipid bilayer. A given M domain may employ one or more mechanisms of interaction with a lipid bilayer. Each multimeric assembly comprises one or more M domains. In some embodiments, each oligomeric substructure in a multimeric assembly comprises one or more M domains. In other embodiments, some fraction (30%, 40%, 50%, 60%, 70%, 80%, 90%, or more) of the plurality of proteins comprise one or more M domains. In other embodiments, each protein in the plurality of proteins comprises one or more M domains. In all embodiments, one or more M domains is required per multimeric assembly in order to drive association of the multimeric assembly with the lipid bilayer via any suitable mechanism.

The M domains present in a resulting multimeric assembly may all be the same, all different, or some the same and some different.

In various embodiments, the one or more M domains may comprise or consist of a polypeptide having an acylation motif, including but not limited to N-terminal myristoylation motifs (including but not limited to MGXXXT/S (SEQ ID NO: 300) motif and non-limiting example sequences 1-92 below), palmitoylation motifs (including but not limited to non-limiting example sequences 93-99 below), farnesylation motifs, and geranylgeranylation motifs (Resh M (1999) Fatty acylation of proteins: new insights into membrane targeting of myristoylated and palmitoylated proteins. Biochim. Biophys. Acta 1451:1-16; Resh M (2013) Covalent lipid modifications of proteins. Curr. Biol. 23:R431-5); a polar headgroup-binding domain (including but not limited to non-limiting example sequences 100-106 in the attached appendices and the domains defined in: Stahelin R V (2009) Lipid binding domains: more than simple lipid effectors. J. Lipid Res. 50:S299-304); or transmembrane protein domains (the latter preferably when the multimeric assembly is enveloped by a lipid bilayer). In various further embodiments, the M domain may comprise envelope proteins of enveloped viruses, membrane protein transporters, membrane protein channels, B-cell receptors, T-cell receptors, transmembrane antigens of human pathogens, growth factors receptors, G-protein coupled receptors (GPCRs), complement regulatory proteins including but not limited to CD55 and CD59.

In further embodiments, the M domain may comprise or consist of one or more of the following peptides:

```
(Myr1; 6 N-terminal residues of HIV gag)
                                    (SEQ ID NO: 280)
(M)GARAS;

(Myr2; 6 N-terminal residues of MARCKS)
                                    (SEQ ID NO: 281)
(M)GAQFS;

(Myr3; 6 N-terminal residues of Src)
                                    (SEQ ID NO: 282)
(M)GSSKS;

(Myr4; 6 N-terminal residues of Neurocalcin)
                                    (SEQ ID NO: 283)
(M)GKQNS;

(Palm1; 13 N-terminal residues of Lyn kinase)
                                    (SEQ ID NO: 284)
(M)GCIKSKRKDNLN;

(Palm2; 13 N-terminal residues of Gαo)
                                    (SEQ ID NO: 285)
(M)GCTLSAEERAAL;

(Palm3; 13 N-terminal residues of GAP43)
                                    (SEQ ID NO: 286)
(M)LCCMRRTKQVEK;

(Palm4; 13 N-terminal residues of PSD-95)
                                    (SEQ ID NO: 287)
(M)DCLCIVTTKKYR;

(CaaX1; 13 C-terminal residues from K-Ras4B)
                                    (SEQ ID NO: 288)
KKKKKSKTKCVIM;

(CaaX2; 13 C-terminal residues from paralemmin)
                                    (SEQ ID NO: 289)
DMKKHRCKCCSIM;

(CaaX3; 13 C-terminal residues of RhoF)
                                    (SEQ ID NO: 290)
AQRQKKRRLCLLL;

(CaaX4; 13 C-terminal residues of type II
inositol 1,4,5-trisphosphate 5-phosphatase
isoform X7)
                                    (SEQ ID NO: 291)
AQEFIHQFLCNPL;

(PH; Residues 11-40 of rat PLCδ)
                                    (SEQ ID NO: 292)
HGLQDDPDLQALLKGSQLLKVKSSSWRRERFYKLQEDCKTIWQESRKV

MRSPESQLFSIEDIQEVRMGHRTEGLEKFARDIPEDRCFSIVFKDQRN

TLDLIAPSPADAQHWVQGLRKIIHHSGSMDQRQK;

(C1; residues 246-297 of human PCKδ isoform X2)
                                    (SEQ ID NO: 293)
PHRFKVHNYMSPTFCDHCGSLLWGLVKQGLKCEDCGMNVHHKCREKVA

NLCG;

(C2; residues 1384-1509 of mouse PI3K)
                                    (SEQ ID NO: 294)
GAVKLSVSYRNGTLFIMVMHIKDLVTEDGADPNPYVKTYLLPDTHKTS

KRKTKISRKTRNPTFNEMLVYSGYSKETLRQRELQLSVLSAESLRENF

FLGGITLPLKDFNLSKETVKWYQLTAATYL;
and/or
```

(PX; residues 2-149 of human p40phox)

(SEQ ID NO: 295)
AVAQQLRAESDFEQLPDDVAISANIADIEEKRGFTSHFVFVIEVKTKG

GSKYLIYRRYRQFHALQSKLEERFGPDSKSSALACTLPTLPAKVYVGV

KQEIAEMRIPALNAYMKSLLSLPVWVLMDEDVRIFFYQSPYDSEQVPQ

ALRR

Further exemplary M domains may comprise or consist of one or more of the peptides that follow (Resh M (1999) Biochim. Biophys. Acta 1451:1-16; Resh M (2013) Curr. Biol. 23:R431-5; Stahelin R V (2009) J. Lipid Res. 50:S299-304):

A. The following peptides are present at the N terminus of the polypeptide in which they appear in order to function as an M domain.

1. Any amino acid sequence conforming to the consensus motif
(SEQ ID NO: 300)
(M)GXXX(S/T),
where the M is in the initiator methionine at the N terminus of the polypeptide sequence.

2.
(SEQ ID NO: 280)
(M)GARAS 3.
(SEQ ID NO: 296)
(M)GCIKSKGKDSLS 4.
(SEQ ID NO: 297)
(M)GCINSKRKD 5.
(SEQ ID NO: 298)
(M)GSSKSKPKDPSQRRR 6.
(SEQ ID NO: 299)
(M)GCIKSKEDKGPAMKY 7.
(SEQ ID NO: 52)
(M)GCVQCKDKEATKLTE 8.
(SEQ ID NO: 53)
(M)GCIKSKRKDNLNDDE 9.
(SEQ ID NO: 54)
(M)GCVCSSNPEDDWMEN 10.
(SEQ ID NO: 55)
(M)GCMKSKFLQVGGNTG 11.
(SEQ ID NO: 56)
(M)GCVFCKKLEPVATAK 12.
(SEQ ID NO: 57)
(M)GCVHCKEKISGKGQG 13.
(SEQ ID NO: 58)
(M)GLLSSKRQVSEKGKG 14.
(SEQ ID NO: 59)
(M)GQQPGKVLGDQRRPS 15.
(SEQ ID NO: 60)
(M)GQQVGRVGEAPGLQQ 16.
(SEQ ID NO: 61)
(M)GNAAAAKKGSEQESV 17.
(SEQ ID NO: 62)
(M)GNAATAKKGSEVESV 18.
(SEQ ID NO: 63)
(M)GAQLSLVVQASPSIA 19.
(SEQ ID NO: 64)
(M)GHALCVCSRGTVIID 20.
(SEQ ID NO: 65)
(M)GQLCCFPFSRDEGKI 21.
(SEQ ID NO: 66)
(M)GNEASYPLEMCSHFD 22.
(SEQ ID NO: 67)
(M)GNSGSKQHTKHNSKK 23.
(SEQ ID NO: 68)
(M)GCTLSAEDKAAVERS 24.
(SEQ ID NO: 69)
(M)GCTLSAEERAALERS 25.
(SEQ ID NO: 70)
(M)GAGASAEEKHSRELE 26.
(SEQ ID NO: 71)
(M)GCRQSSEEKEAARRS 27.
(SEQ ID NO: 72)
(M)GLSFTKLFSRLFAKK 28.
(SEQ ID NO: 73)
(M)GNIFGNLLKSLIGKK 29.
(SEQ ID NO: 74)
(M)GLTVSALFSRIFGKK 30.
(SEQ ID NO: 75)
(M)GKVLSKIFGNKEMRI 31.
(SEQ ID NO: 76)
(M)GNSKSGALSKEILEE 32.
(SEQ ID NO: 77)
(M)GKQNSKLRPEVMQDL 33.
(SEQ ID NO: 78)
(M)GKRASKLKPEEVEEL 34.
(SEQ ID NO: 79)
(M)GKQNSKLRPEVLQDL 35. (M)GSRASTLLRDEELEE (SEQ ID NO: 80)
36. (M)GSKLSKKKKGYNVND (SEQ ID NO: 81)
37. (M)GKQNSKLRPEMLQDL (SEQ ID NO: 82)
38. (M)GNVMEGKSVEELSST (SEQ ID NO: 83)
39. (M)GQQFSWEEAEENGAV (SEQ ID NO: 84)
40. (M)GNTKSGALSKEILEE (SEQ ID NO: 85)
41. (M)GKQNSKLRPEVLQDL (SEQ ID NO: 86)
42. (M)GAQFSKTAAKGEATA (SEQ ID NO: 87)
43. (M)GSQSSKAPRGDVTAE (SEQ ID NO: 88)
44. (M)GNRHAKASSPQGFDV (SEQ ID NO: 89)
45. (M)GQDQTKQQIEKGLQL (SEQ ID NO: 90)
46. (M)GQALSIKSCDFHAAE (SEQ ID NO: 91)
47. (M)GNRAFKAHNGHYLSA (SEQ ID NO: 92)
48. (M)GARASVLSGGELDRW (SEQ ID NO: 93)
49. (M)GQTVTTPLSLTLDHW (SEQ ID NO: 94)
50. (M)GQAVTTPLSLTLDHW (SEQ ID NO: 95)
51. (M)GNSPSYNPPAGISPS (SEQ ID NO: 96)
52. (M)GQTLTTPLSLTLTHF (SEQ ID NO: 97)
53. (M)GQTITTPLSLTLDHW (SEQ ID NO: 98)
54. (M)GQTVTTPLSLTLEHW (SEQ ID NO: 99)
55. (M)GQELSQHERYVEQLK (SEQ ID NO: 100)
56. (M)GVSGSKGQKLFVSVL (SEQ ID NO: 101)
57. (M)GGKWSKSSVVGWPTV (SEQ ID NO: 102)
58. (M)GQHPAKSMDVRRIEG (SEQ ID NO: 103)
59. (M)GAQVSRQNVGTHSTQ (SEQ ID NO: 104)
60. (M)GLAFSGARPCCCRHN (SEQ ID NO: 105)
61. (M)GNRGSSTSSRPPLSS (SEQ ID NO: 106)
62. (M)GSYFVPPANYFFKDI (SEQ ID NO: 107)
63. (M)GAQLSTLSRVVLSPV (SEQ ID NO: 108)
64. (M)GNLKSVGQEPGPPCG (SEQ ID NO: 109)
65. (M)GSKRSVPSRHRSLTT (SEQ ID NO: 110)
66. (M)GNGESQLSSVPAQKL (SEQ ID NO: 111)
67. (M)GAHLVRRYLGDASVE (SEQ ID NO: 112)
68. (M)GGKLSKKKKGYNVND (SEQ ID NO: 113)
69. (M)GSCCSCPDKDTVPDN (SEQ ID NO: 114)
70. (M)GSSEVSIIPGLQKEE (SEQ ID NO: 115)
71. (M)LCCMRRTKQVEKNDE (SEQ ID NO: 116)
72. (M)GCLGNSKTEDQRNE (SEQ ID NO: 117)
73. (M)TLESIMACCLSEEAKEA (SEQ ID NO: 118)
74. (M)SGVVRTLSRCLLPAEAG (SEQ ID NO: 119)

75.
(M)ADFLPSRSVCFPGCVLTN (SEQ ID NO: 120)

76.
(M)ARSLRWRCCPWCLTEDEKAA (SEQ ID NO: 121)

77.
(M)LCCMRRTKQVEKNDDDQKIEQDGI (SEQ ID NO: 122)

78.
(M)QCCGLVHRRRVRV (SEQ ID NO: 123)

79.
(M)DCLCIVTTKKYRYQDEDTP (SEQ ID NO: 124)

80.
(M)CKGLAGLPASCLRSAKDMK (SEQ ID NO: 125)

81.
(M)GCIKSKEDKGPAMKY (SEQ ID NO: 126)

82.
(M)GCVQCKDKEATKLTE (SEQ ID NO: 127)

83.
(M)GCIKSKRKDNLNDDE (SEQ ID NO: 128)

84.
(M)GCVCSSNPEDDWMEN (SEQ ID NO: 129)

85.
(M)GCMKSKFLQVGGNTG (SEQ ID NO: 130)

86.
(M)GCVFCKKLEPVATAK (SEQ ID NO: 131)

87.
(M)GCVHCKEKISGKGQG (SEQ ID NO: 132)

88.
(M)GCTLSAEDKAAVERS (SEQ ID NO: 133)

89.
(M)GCTLSAEERAALERS (SEQ ID NO: 134)

90.
(M)GCRQSSEEKEAARRS (SEQ ID NO: 135)

91.
(M)GQLCCFPFSRDEGK (SEQ ID NO: 136)

92.
(M)GNLKSVGQEPGPPCGLGLGLGLCGK (SEQ ID NO: 137)

B. The following peptides are at the C terminus of the polypeptide in which they appear in order to function as an M domain.

93.
SGPGCMSCKCVLS (SEQ ID NO: 138)

94.
GTQGCMGLPCVVM (SEQ ID NO: 139)

95.
TPGCVKIKKCVIM (SEQ ID NO: 140)

96.
DMKKHRCKCCSIM (SEQ ID NO: 141)

97.
SKDGKKKKKSKTKCVIM (SEQ ID NO: 142)

98.
KKKKKKSKTKCVIM (SEQ ID NO: 143)

99.
SKTKCVIM (SEQ ID NO: 144)

C. The following peptides are non-limiting examples of polar headgroup-binding domains that can function as M domains. These domains can appear anywhere in the polypeptides of the disclosure consistent with proper folding and multimerization of the multimeric assembly.

100. (SEQ ID NO: 145)
HGLQDDPDLQALLKGSQLLKVKSSSWRRERFYKLQEDCKTIWQESRK
VMRSPESQLFSIEDIQEVRMGHRTEGLEKFARDIPEDRCFSIVFKDQ
RNTLDLIAPSPADAQHWVQGLRKIIHHSGSMDQRQK 101. (SEQ ID NO: 146)
(M)DSGRDFLTLHGLQDDPDLQALLKGSQLLKVKSSSWRRERFYKLQ
EDCKTIWQESRKVMRSPESQLFSIEDIQEVRMGHRTEGLEKFARDIP
EDRCFSIVFKDQRNTLDLIAPSPADAQHWVQGLRKIIHHSGSMDQRQ
K 102. (SEQ ID NO: 147)
(M)DSGRDFLTLHGLQDDPDLQALLKGSQLLKVKSSSWRRERFYKLQ
EDCKTIWQESRKVMRSPESQLFSIEDIQEVRMGHRTEGLEKFARDIP
EDRCFSIVFKDQRNTLDLIAPSPADVQHWVQGLRKIIDRSGSMDQRQ
K 103. (SEQ ID NO: 148)
(M)DSGRDFLTLHGLQDDEDLQALLKGSQLLKVKSSSWRRERFYKLQ
EDCKTIWQESRKVMRTPESQLFSIEDIQEVRMGHRTEGLEKFARDVP
EDRCFSIVFKDQRNTLDLIAPSPADAQHWVLGLHKIIHHSGSMDQRQ
K 104. (SEQ ID NO: 149)
HGLQDDEDLQALLKGSQLLKVKSSSWRRERFYKLQEDCKTIWQESRK
VMRTPESQLFSIEDIQEVRMGHRTEGLEKFARDVPEDRCFSIVFKDQ
RNTLDLIAPSPADAQHWVLGLHKIIHHSGSMDQRQK

-continued

105.

(SEQ ID NO: 150)
(M)SGGKYVDSEGHLYTVPIREQGNIYKPNNKAMAEEMNEKQVYDAH

TKEIDLVNRDPKHLNDDVVKIDFEDVIAEPEGTHSFDGIWKASFTTF

TVTKYWFYRLLSALFGIPMALIWGIYFAILSFLHIWAVVPCIKSFLI

EIQCISRVYSIYVHTFCDPLFEAIGKIFSNIRINTQKEI

106.

(SEQ ID NO: 151)
(M)SGGKYVDSEGHLYTVPIREQGNIYKPNNKAMADELSEKQVYDAH

TKEIDLVNRDPKHLNDDVVKIDFEDVIAEPEGTHSFDGIWKASFTTF

TVTKYWFYRLLSALFGIPMALIWGIYFAILSFLHIWAVVPCIKSFLI

EIQCISRVYSIYVHTVCDPLFEAVGKIFSNVRINLQKEI

Based on the disclosure herein, it is well within the level of those of skill in the art to identify M domains suitable for use in producing the multimeric assemblies of the disclosure. An M domain for use in the present disclosure can be any suitable polypeptide domain that is capable of binding to a lipid bilayer via any suitable mechanism, including but not limited to non-covalently interacting with the lipid bilayer membrane. As will be known to those of skill in the art, an M domain can be demonstrated to perform the function of membrane binding using a variety of standard assays. Many in vitro assays exist for assaying whether or not a polypeptide interacts with lipid membranes and for evaluating the characteristics of the interaction, such as the nature of the interaction (e.g., electrostatic or hydrophobic), the strength of the interaction, and whether the interaction deforms or remodels the membrane. Such assays include but are not limited to vesicle sedimentation assays, vesicle co-flotation assays, isothermal titration calorimetry, measuring changes in intrinsic or extrinsic protein or lipid fluorescence, fluorescence anisotropy, and membrane morphology analysis by electron microscopy or fluorescence microscopy (Zhao H, Lappalainen P (2012) A simple guide to biochemical approaches for analyzing lipid-protein interactions. Mol. Biol. Cell 23:2823-30). In addition, M domain-dependent localization of proteins to membranes in cells can also be used as an assay for the interaction of an M domain with membranes, and can yield information about the specificity of a given M domain for particular membranes, membrane subdomains, or lipids (Zacharias D A, Violin J D, Newton A C, Tsien R Y (2002) Partitioning of lipid-modified GFPs into membrane microdomains in live cells. Science 296:913-916; Lemmon M A (2008) Membrane recognition by phospholipid-binding domains. Nat. Rev. Mol. Cell. Biol. 9:99-111). Whether in vitro or in cells, either an isolated M domain or an M domain linked via genetic fusion or another method to a carrier protein that facilitates observation (for example, green fluorescent protein) can be used to evaluate the ability of the M domain to interact with lipid membranes.

An L domain for use in the present disclosure can be any suitable polypeptide that is capable of effecting membrane scission by recruiting the ESCRT machinery to the site of budding by binding to one or more ESCRT or ESCRT-associated proteins directly or indirectly via any suitable mechanism, including but not limited to non-covalently or covalently. Preferably, the L domain interacts with proteins known to recruit the ESCRT machinery to sites of budding in vivo, such as Tsg101, ALIX, or the Nedd4 family of ubiquitin E3 ligases (McDonald B, Martin-Serrano J (2009) No strings attached: the ESCRT machinery in viral budding and cytokinesis. J. Cell Sci. 122:2167-77; Votteler J, Sundquist W I (2013) Virus budding and the ESCRT pathway. Cell Host & Microbe 14:232-41). Most preferably, the L domain interacts with the human, murine, or other mammalian forms of these proteins. Each protein subunit in a multimeric assembly contains one or more L domains. The L domains present in a resulting multimeric assembly may all be the same, all different, or some the same and some different.

In various embodiments, the one or more L domains may comprise or consist of a a linear amino acid sequence motif selected from the group consisting of P(T/S)AP (SEQ ID NO: 152), $\Phi YX_{0/2}(P/\Phi)X_{0/3}(L/I)$ (SEQ ID NO: 153), PPXY (SEQ ID NO: 154), and overlapping combinations thereof (Bieniasz P D (2006) Late budding domains and host proteins in enveloped virus release. Virology 344:55-63; Votteler J, Sundquist W I (2013) Virus budding and the ESCRT pathway. Cell Host & Microbe 14:232-41), where $\Phi$ denotes a hydrophobic residue, X can be any amino acid, and numbered subscripts indicate amino acid spacers of varying lengths. Such overlapping combinations include, but are not limited to P(T/S)APPXY (SEQ ID NO: 155), P(T/S)APYP(X)$_n$L (SEQ ID NO: 156), PPXYP(T/S)AP (SEQ ID NO: 157), PPXYYP(X)$_n$L (SEQ ID NO: 158), YP(X)$_n$LPPXY (SEQ ID NO: 159), and YP(X)$_n$LPPXY (SEQ ID NO: 160).

Further exemplary L domains may comprise or consist of one or more of the peptides that follow:

(SEQ ID NO: 161)
PTAPPEE;

(SEQ ID NO: 162)
YPLTSL;

(SEQ ID NO: 163)
PTAPPEY;

(SEQ ID NO: 164)
YPDL;

(SEQ ID NO: 165)
FPIV;

(SEQ ID NO: 166)
PTAPPEY;

(SEQ ID NO: 167)
PTAP;

(SEQ ID NO: 168)
PPEY;

(SEQ ID NO: 169)
YPLTSL;
and/or (SEQ ID NO: 165)
FPIV.

As will be understood by those of skill in the art, the L domain may include additional sequences, beyond those directly responsible for recruiting the ESCRT machinery, as appropriate for an intended use, so long as the ESCRT-recruitment motifs are not buried in the peptide core in such a way as to render them inaccessible for binding their interaction partners. In various further embodiments, the L domain may comprise or consist of the following peptides that include one or more ESCRT-recruitment motifs plus additional residues (ESCRT-recruitment motifs noted by underlined text):

(HIV Gag p6 domain)

(SEQ ID NO: 172)
LQSRPEPTAPPEESFRSGVETTTPPQKQEPIDKELYPLTSLRSLFGN

DPSSQ;

(residues 2-21 of Ebola VP40)

(SEQ ID NO: 173)
RRVILPTAPPEYMEAIYPVR;

(EIAV Gag p9 domain)

(SEQ ID NO: 174)
PIQQKSQHNKSVVQETPQTQNLYPDLSEIKKEYNVKEKDQVEDLNLD

SLWE;

(residues 12-31 of SV5 M)

(SEQ ID NO: 175)
NPRQSIKAFPIVINSDGGEK;

(SEQ ID NO: 176)
PTAPPEYGGS;

(SEQ ID NO: 177)
PTAPGGS;

(SEQ ID NO: 178)
PPEYGGS;

(SEQ ID NO: 179)
YPLTSLGGS;

(SEQ ID NO: 180)
YPDLGGS;

(SEQ ID NO: 181)
FPIVGGS;

(HIV Gag p6 domain mutant (SEQ ID NO: 182),
p6(ΔPTAP))

(SEQ ID NO: 183)
LQSRPEAAAAPEESFRSGVETTTPPQKQEPIDKELYPLTSLRSLFGN

DPSSQ;
and/or (HIV Gag p6 domain mutant (SEQ ID NO: 184),
p6(ΔYP))
LQSRPEPTAPPEESFRSGVETTTPPQKQEPIDKELAALTSLRSLFGN

DPSSQ

Further exemplary L domains comprise or consist of one or more of the following polypeptides:

1.

(SEQ ID NO: 186)
QSRPEPTAPPEESFRSGVETTTPPQKQEPIDKELYPLTSLRSLFGND
PSSQ

2.

(SEQ ID NO: 187)
DPQIPPPPYVEPTAPQV

3.

(SEQ ID NO: 188)
LLTEDPPPYRD

4.

(SEQ ID NO: 189)
TASAPPPPYVG

5.

(SEQ ID NO: 190)
TPQTQNLYPDLSEIK

6.

(SEQ ID NO: 191)
(M)RRVILPTAPPEYMEAI

7.

(SEQ ID NO: 192)
NTYMQYLNPPPYADHS

8.

(SEQ ID NO: 193)
LGIAPPPYEEDTSMEYAPSAP

9.

(SEQ ID NO: 194)
DDLWLPPPEYVPLKEL

10.

(SEQ ID NO: 195)
AAPTAPPTGAADSIPPPYSP

11.

(SEQ ID NO: 196)
TAPSSPPPYEE

12.

(SEQ ID NO: 197)
QSIKAFPIVINSDG

13.

(SEQ ID NO: 185)
SREKPYKEVTEDLLHLNSL

14.

(SEQ ID NO: 170)
AAGAYDPARKLLEQYAKK

15.

(SEQ ID NO: 171)
PNCFNSSINNIHEMEIQLKDALEKNQQWLVYDQQREVYVKGLLAKIF
ELEKKTETAAHSLPQQTKKPESEGYLQEEKQKC

16.

(SEQ ID NO: 305)
RKSPTPSAPVPLTEPAAQ

17.

(SEQ ID NO: 306)
(M)SLYPSLEDLKVDKVIQAQTAFSANPANPAILSEASAPIPHDGNL
YPRLYPELSQYMGLSLN

Based on the disclosure herein, it is well within the level of those of skill in the art to identify L domains suitable for use in producing the multimeric assemblies of the disclosure. An L domain for use in the present disclosure can be any suitable polypeptide domain that is capable of effecting membrane scission and release of an enveloped protein nanocage from a cell by recruiting the ESCRT machinery to the site of budding by binding to one or more ESCRT proteins directly or indirectly via any suitable mechanism, including but not limited to non-covalently or covalently. As will be known to those with skill in the art, the ability of an L domain to recruit the ESCRT machinery and effect membrane scission and release of an enveloped protein nanocage can be assessed using budding assays. In the budding assay, a candidate L domain is genetically fused to a viral structural protein that has been rendered defective in budding by mutation or deletion of its late domain, and the ability of the candidate L domain to restore budding of virus-like particles is evaluated by analyzing the culture supernatant for the presence of the viral structural protein using standard techniques such as SDS-PAGE and Western blotting (Parent L J, Bennett R P, Craven R C, Nelle T D, Krishna N K, Bowzard J B, Wilson C B, Puffer B A, Montelaro R C, Wills J W (1995) Positionally independent and exchangeable late budding functions of the Rous Sarcoma Virus and Human Immunodeficiency Virus Gag proteins. J. Virol. 69:5455-5460). Any viral structural protein that is known to be defective in budding can be used in the budding assay, including but not limited to budding-defective versions of HIV-1 Gag, RSV Gag, MuMoLV Gag, SV5 M, Ebola VP40 and other structural proteins from different families of enveloped viruses including retroviruses, filoviruses, rhabdoviruses, arenaviruses, and paramyxoviruses. In addition, as the inventors describe below, the multimeric assemblies of the disclosure can be used to test the ability of an L domain to effect membrane scission and release of an enveloped protein nanocage in a similar manner. The L domain of an enveloped protein nanocage can be replaced with a candidate L domain, and the ability of the resulting construct to be released from cells can be determined by analyzing the culture supernatant for the presence of the protein subunits of the multimeric assembly using standard techniques such as SDS-PAGE and Western blotting. Finally, as will be known to those with skill in the art, the ability of an L domain to bind to one or more ESCRT proteins directly or indirectly can be assessed using a variety of biochemical, biophysical, and cell biological techniques including but not limited to co-immunoprecipitation, pull-down assays, isothermal titration calorimetry, biosensor binding assays, NMR spectroscopy, and X-ray crystallography.

In a further embodiment, the multimeric assembly of any embodiment or combination of embodiments may further comprise a packaging moiety other than the RBDs. As used herein, a "packaging moiety" may be any moiety capable of interacting with a desired additional "cargo" (i.e.: other than the one or more active component), with the effect of recruiting the additional cargo to the multimeric assembly. The interaction between the packaging moiety and the cargo can be any type of interaction, covalent or non-covalent, that results in effective interaction with and recruitment to the multimeric assembly. As will be apparent to those of skill in the art, the ability to widely modify surface amino acid residues without disruption of the protein structure permits many types of modifications to endow the resulting self-assembled multimers with a variety of functions. In one non-limiting example, the protein, first protein, and/or second protein can be modified, such as by introduction of various cysteine residues or non-canonical amino acids at defined positions to facilitate linkage to one or more cargo of interest. In another non-limiting example, the protein may be modified to comprise as a genetic fusion a polypeptide domain or sequence known to interact with a desired cargo covalently or non-covalently. In one embodiment, a non-canonical amino acid can be incorporated recombinantly using amber codon suppression (see L. Wang, A. Brock, B. Herberich, P. G. Schultz, Science 292, 498 (2001)). In another embodiment, the packaging moiety comprises the polypeptide sequence: QSRPEPTAPPEESFRSGVETTTPPQKQEPIDKELYPLTSLRSLFGNDPSSQ (SEQ ID NO: 186), wherein the packaging moiety polypeptide is expressed as a genetic fusion with the M domain, the L domain, or the O domain. This sequence is the p6 domain of HIV Gag, which is known to interact with the HIV protein Vpr (SEQ ID NO: 202) via a non-covalent protein-protein interaction (Cavrois M, et al. (2002) Nat. Biotech. 20:1151-4). By including SEQ ID NO: 186 in a multimeric assembly of the disclosure, any polypeptide sequence or other molecule that is fused, tethered, or otherwise connected to the Vpr sequence can be packaged into the multimeric assembly.

In another embodiment, the multimeric assembly further comprises a cargo that interacts with the packaging moiety. Such a "cargo" may be anything of interest that can be linked to or interact with the packaging domain and thus recruited to the multimeric assembly, including but not limited to therapeutics, diagnostics, antigens, adjuvants, imaging agents, dyes, radioisotopes, etc. Alternatively, if the cargo is a protein or polypeptide, the cargo can be expressed as a genetic fusion with the M domain, the L domain, or the O domain in order to directly incorporate the cargo into the multimeric assembly without the use of a distinct packaging domain.

As will be understood by those of skill in the art, the M, L, O domains, and RBDs (and the packaging moiety in appropriate embodiments) may be contiguous in each protein, or may be separated by linker peptides as deemed appropriate. Any suitable linker may be used as deemed appropriate for an intended multimeric structure. In various non-limiting embodiments, the linkers may comprise or consist of one or more of the polypeptide sequences GSGS (SEQ ID NO: 223); GSDGSGRSGS(SEQ ID NO: 224); GSKSGSGSDSGS (SEQ ID NO: 225); and/or GSGSGDGGRGSRGGDGSGGSSG (SEQ ID NO: 226).

As will further be understood by those of skill in the art, any suitable combination of M, L, O domains, and RBDs (and packaging moiety and linkers in appropriate embodiments) may be used to produce the protein that assembles to form an intended multimeric assembly of the disclosure.

In various non-limiting embodiments, the recombinant polypeptide comprises the amino acid sequence selected from the group consisting of SEQ ID NOS: 266 and 379-387.

EPN-01-mnb

SEQ ID NO: 266

(M)GARASGSKSGSGSDSGSKIEELFKKHKIVAVLRANSVEEAKKKA
LAVFLGGVHLIEITFTVPDADTVIKELSFLKEMGAIIGAGTVTSVEQ
CRKAVESGAEFIVSPHLDEEISQFCKEKGVFYMPGVMTPTELVKAMK
LGHTILKLFPGEVVGPQFVKAMKGPFPNVKFVPTGGVNLDNVCEWFK
AGVLAVGVGSALVKGTPVEVAEKAKAFVEKIRGCTE(QKLISEEDL)
LQSRPEPTAPPEESFRSGVETTTPPQKQEPIDKELYPLTSLRSLFGN
DPSSQ<u>GGSKGS</u>*RPRGTRGKGRRIRR*

EPN-01-1wa3-1mnb

SEQ ID NO: 379

(M)GARASGSKSGSGSDSGSKIEELFKKHKIVAVLRANSVEEAKEKA
LAVFEGGVHLIEITFTVPDADTVIKELSFLKEKGAIIGAGTVTSVEQ
CRKAVESGAEFIVSPHLDEEISQFCKEKGVFYMPGVMTPTELVKAMK
LGHTILKLFPGEVVGPQFVKAMKGPFPNVKFVPTGGVNLDNVCEWFK
AGVLAVGVGSALVKGTPDEVREKAKAFVEKIRGCTE(QKLISEEDL)
QSRPEPTAPPEESFRSGVETTTPPQKQEPIDKELYPLTSLRSLFGND
PSSQ<u>GGSKGS</u>*RPRGTRGKGRRIRR*

EPN-11-1g70

SEQ ID NO: 380

(M)GCIKSKRKDNLNLQSRPEPTAPPEESFRSGVETTTPPQKQEPID
KELYPLTSLRSLFGNDPSSQKIEELFKKHKIVAVLRANSVEEAKKKA
LAVFLGGVHLIEITFTVPDADTVIKELSFLKEMGAIIGAGTVTSVEQ
CRKAVESGAEFIVSPHLDEEISQFCKEKGVFYMPGVMTPTELVKAMK

LGHTILKLFPGEVVGPQFVKAMKGPFPNVKFVPTGGVNLDNVCEWFK

AGVLAVGVGSALVKGTPVEVAEKAKAFVEKIRGCTE(QKLISEEDL)

GGSKGS*DRRRRGSRPSGAERRRRRAAAA*

EPN-11-1wa3-1g70
SEQ ID NO: 381
(M)GCIKSKRKDNLNLQSRPEPTAPPEESFRSGVETTTPPQKQEPID

KELYPLTSLRSLFGNDPSSQKIEELFKKHKIVAVLRANSVEEAKEKA

LAVFEGGVHLIEITFTVPDADTVIKELSFLKEKGAIIGAGTVTSVEQ

CRKAVESGAEFIVSPHLDEEISQFCKEKGVFYMPGVMTPTELVKAMK

LGHTILKLFPGEVVGPQFVKAMKGPFPNVKFVPTGGVNLDNVCEWFK

AGVLAVGVGSALVKGTPDEVREKAKAFVEKIRGCTE(QKLISEEDL)

GGSKGS*DRRRRGSRPSGAERRRRRAAAA*

EPN-11-1wa3-1mnb
SEQ ID NO: 382
(M)GCIKSKRKDNLNLQSRPEPTAPPEESFRSGVETTTPPQKQEPID

KELYPLTSLRSLFGNDPSSQKIEELFKKHKIVAVLRANSVEEAKEKA

LAVFEGGVHLIEITFTVPDADTVIKELSFLKEKGAIIGAGTVTSVEQ

CRKAVESGAEFIVSPHLDEEISQFCKEKGVFYMPGVMTPTELVKAMK

LGHTILKLFPGEVVGPQFVKAMKGPFPNVKFVPTGGVNLDNVCEWFK

AGVLAVGVGSALVKGTPDEVREKAKAFVEKIRGCTE(QKLISEEDL)

GGSKGS*RPRGTRGKGRRIRR*

EPN-11-1wa3-u1a (Palm1-Late1-1wa3-myc-u1a)
SEQ ID NO: 383
(M)GCIKSKRKDNLNLQSRPEPTAPPEESFRSGVETTTPPQKQEPID

KELYPLTSLRSLFGNDPSSQKIEELFKKHKIVAVLRANSVEEAKEKA

LAVFEGGVHLIEITFTVPDADTVIKELSFLKEKGAIIGAGTVTSVEQ

CRKAVESGAEFIVSPHLDEEISQFCKEKGVFYMPGVMTPTELVKAMK

LGHTILKLFPGEVVGPQFVKAMKGPFPNVKFVPTGGVNLDNVCEWFK

AGVLAVGVGSALVKGTPDEVREKAKAFVEKIRGCTE(QKLISEEDL)

GGSKGS*AVPETRPNHTIYINNLNEKIKKDELKKSLHAIFSRFGQILD*

*ILVSRSLKMRGQAFVIFKEVSSATNALRSMQGFPFYDKPMRIQYAKT*

*DSDIIAKMK*

EPN-11-com (Palm1-Late1-I301-myc-com)
SEQ ID NO: 384
(M)GCIKSKRKDNLNLQSRPEPTAPPEESFRSGVETTTPPQKQEPID

KELYPLTSLRSLFGNDPSSQKIEELFKKHKIVAVLRANSVEEAKKKA

LAVFLGGVHLIEITFTVPDADTVIKELSFLKEMGAIIGAGTVTSVEQ

CRKAVESGAEFIVSPHLDEEISQFCKEKGVFYMPGVMTPTELVKAMK

LGHTILKLFPGEVVGPQFVKAMKGPFPNVKFVPTGGVNLDNVCEWFK

AGVLAVGVGSALVKGTPVEVAEKAKAFVEKIRGCTE(QKLISEEDL)

GGSKGS*KSIRCKNCNKLLFKADSFDHIEIRCPRCKRHIIMLNACEHP*

*TEKHCGKREKITHSDETVRY*

EPN-11-HIV_NC (Palm1-Late1-I301-myc-HIV_NC)
SEQ ID NO: 385
(M)GCIKSKRKDNLNLQSRPEPTAPPEESFRSGVETTTPPQKQEPID

KELYPLTSLRSLFGNDPSSQKIEELFKKHKIVAVLRANSVEEAKKKA

LAVFLGGVHLIEITFTVPDADTVIKELSFLKEMGAIIGAGTVTSVEQ

CRKAVESGAEFIVSPHLDEEISQFCKEKGVFYMPGVMTPTELVKAMK

LGHTILKLFPGEVVGPQFVKAMKGPFPNVKFVPTGGVNLDNVCEWFK

AGVLAVGVGSALVKGTPVEVAEKAKAFVEKIRGCTE(QKLISEEDL)

GGSKGS*MQKGNFRNQRKTVKCFNCGKEGHIAKNCRAPRKKGCWKCGK*

*EGHQMKDCTERQAN*

EPN-11-mnb (Palm1-Late1-I301-myc-mnb)
SEQ ID NO: 386
(M)GCIKSKRKDNLNLQSRPEPTAPPEESFRSGVETTTPPQKQEPID

KELYPLTSLRSLFGNDPSSQKIEELFKKHKIVAVLRANSVEEAKKKA

LAVFLGGVHLIEITFTVPDADTVIKELSFLKEMGAIIGAGTVTSVEQ

CRKAVESGAEFIVSPHLDEEISQFCKEKGVFYMPGVMTPTELVKAMK

LGHTILKLFPGEVVGPQFVKAMKGPFPNVKFVPTGGVNLDNVCEWFK

AGVLAVGVGSALVKGTPVEVAEKAKAFVEKIRGCTE(QKLISEEDL)

GGSKGS*RPRGTRGKGRRIRR*

EPN-11-u1a (Palm1-Late1-I301-myc-u1a)
SEQ ID NO: 387
(M)GCIKSKRKDNLNLQSRPEPTAPPEESFRSGVETTTPPQKQEPID

KELYPLTSLRSLFGNDPSSQKIEELFKKHKIVAVLRANSVEEAKKKA

LAVFLGGVHLIEITFTVPDADTVIKELSFLKEMGAIIGAGTVTSVEQ

CRKAVESGAEFIVSPHLDEEISQFCKEKGVFYMPGVMTPTELVKAMK

LGHTILKLFPGEVVGPQFVKAMKGPFPNVKFVPTGGVNLDNVCEWFK

AGVLAVGVGSALVKGTPVEVAEKAKAFVEKIRGCTE(QKLISEEDL)

GGSKGS*AVPETRPNHTIYINNLNEKIKKDELKKSLHAIFSRFGQILD*

*ILVSRSLKMRGQAFVIFKEVSSATNALRSMQGFPFYDKPMRIQYAKT*

*DSDIIAKMK*

The compositions may be present, enveloped in a lipid bilayer (enveloped protein nanocage ("EPN")) after membrane scission is effected by recruiting the ESCRT machinery to the site of budding as described above. Thus, in another embodiment, the composition of any embodiment or combination of embodiments further comprises a lipid bilayer enveloping the composition, wherein one or more of the M domains of each multimeric assembly, oligomeric structure, and/or protein is bound to the lipid bilayer. The inventors have shown that such lipid bilayer membrane-enveloped protein nanocages can be readily produced by eukaryotic cells expressing the recombinant polypeptides and compositions of the disclosure (see below). This embodiment of the multimeric assemblies of the disclosure is particularly useful for delivery of a desired cargo to a cell or tissue of interest. The inventors have shown that the preparation of EPNs requires the presence of M domains, O interfaces, and L domains in the multimeric assemblies. The M domains enable the multimeric assemblies to interact with the host cell membrane. As will be understood by those of skill in the art, it is not required that all M domains in a multimeric assembly actually interact with the lipid bilayer, so long as the plurality of M domains in the multimeric assembly are adequate to drive association with the membrane and/or result in deformation of the lipid bilayer upon multimerization. As such, and as the inventors have shown in the examples below, it is not required that all protein subunits in a multimeric assembly comprise an M domain, so long as the plurality of M domains in the multimeric assembly are adequate to drive association with the membrane and/or result in deformation of the lipid bilayer upon multimerization. Many enveloped viruses are known to package host cell molecules inside or within their membranes envelopes in this manner (e.g., Gentili M, et al. (2015) Transmission of innate immune signaling by packaging of cGAMP in viral particles. Science 349:1232-6; Bridgeman A, et al. (2015) Viruses transfer the antiviral second messenger cGAMP between cells. Science 349: 1228-32; Apolonia L et al. (2015), PLoS Pathogens 11:e1004609; Rosa A et al. (2015), 526:212-7; Usami Y, et al. (2015), Nature 526:218-23).

The O interfaces are required to drive self-assembly or multimerization of the multimeric assemblies. This process both defines the structure of the multimeric assemblies as described above and enhances membrane binding and/or drives deformation of the lipid bilayer membrane to form bud-like structures that remain tethered to the host cell by a membrane neck. The L domains are required to recruit the host cell ESCRT machinery to the site of budding in order to effect release of the budding EPN from the host cell by scission of the membrane neck. The L domains may recruit the ESCRT machinery by interacting directly or indirectly with protein subunits of the ESCRT complex. In certain embodiments, it is preferred that the L domains of the multimeric assemblies interact with host proteins known to recruit the ESCRT machinery to sites of virus budding in cells. Such proteins include but are not limited to Tsg101, ALIX, and members of the Nedd4 family of ubiquitin ligases (McDonald B, Martin-Serrano J (2009) No strings attached: the ESCRT machinery in viral budding and cytokinesis. J. Cell Sci. 122:2167-77).

In another embodiment, the EPN further comprises one or more transmembrane protein or membrane-anchored protein embedded in the lipid bilayer. This embodiment may be used to add additional functionality of any desired type to the multimeric assemblies. In this embodiment, the transmembrane protein or membrane-anchored protein may be one not present as part of the oligomeric substructure or recombinant polypeptide, in that they are added to the assembly during or after envelopment of the multimeric assembly by the lipid bilayer and do not necessarily interact with the protein subunits of the multimeric assembly either covalently or non-covalently. Any suitable transmembrane protein or membrane-anchored protein can be added that provides any desired additional functionality to the assembly, in terms of cell targeting, the display of transmembrane or membrane-anchored antigen for vaccines, or other desired use. In one non-limiting example, the transmembrane protein or membrane-anchored protein embedded in the lipid bilayer comprises a viral envelope protein that enables the EPN to enter cells via receptor-mediated endocytosis and/or mediates fusion of the lipid bilayer of the EPN with cellular membranes. In the study of enveloped viruses, the practice of incorporating a foreign viral envelope protein in the membrane of an enveloped virus is referred to as "pseudotyping." By co-expressing the foreign viral envelope protein with the viral or virus-like particle proteins, the foreign viral envelope protein becomes embedded in the membrane bilayer of the cells, and is therefore incorporated into the membrane envelope of the budding virions or virus-like particles. Viral envelope proteins (in one embodiment, the G protein of Vesicular Stomatitis Virus) can be incorporated in the membrane envelopes of the EPNs of the disclosure in a similar manner. In various non-limiting embodiments, additional classes of membrane proteins can be incorporated into the membrane envelopes of the multimeric assemblies of the disclosure. In various non-limiting embodiments, the transmembrane or membrane-anchored protein is selected from the group consisting of the envelope proteins of enveloped viruses, membrane protein transporters, membrane protein channels, B cell receptors, T cell receptors, transmembrane antigens of human pathogens, growth factors receptors, G-protein coupled receptors (GPCRs), complement regulatory proteins including but not limited to CD55 and CD59, or processed versions thereof.

In some embodiments, the one or more transmembrane protein or membrane-anchored protein embedded in the lipid bilayer comprises a cell-targeting polypeptide displayed on an outer surface of the lipid bilayer. In one such embodiment, the cell-targeting polypeptide is a viral fusion polypeptide. In specific embodiments, the one or more transmembrane protein or membrane-anchored protein embedded in the lipid bilayer comprise one or more of the following polypeptides, or a processed version thereof. As will be understood by those of skill in the art, the polypeptide sequences provided are full-length protein precursors, which are cleaved or otherwise processed (i.e., "processed") to generate the final envelope protein embedded in the lipid bilayer.

In specific embodiments, cell targeting and fusion with the endosome are mediated by two separate polypeptides. By way of non-limiting example, a variant of VSV-G with mutation P127D exhibiting receptor binding activity and no fusion activity co-displayed with a variant of Sindbis virus E3-E2-6K-E1 envelope polyprotein with mutations inactivating receptor binding and conserving fusion activity could be used to deliver cargos to the cytosol of a target cell. See FIG. 10.

VSV-G
(SEQ ID NO: 307)
MKCLLYLAFLFIGVNCKFTIVFPHNQKGNWKNVPSNYHYCPSSSDLN

WHNDLIGTALQVKMPKSHKAIQADGWMCHASKWVTTCDFRWYGPKYI

THSIRSFTPSVEQCKESIEQTKQGTWLNPGFPPQSCGYATVTDAEAV

IVQVTPHHVLVDEYTGEWVDSQFINGKCSNYICPTVHNSTTWHSDYK

VKGLCDSNLISMDITFFSEDGELSSLGKEGTGFRSNYFAYETGGKAC

KMQYCKHWGVRLPSGVWFEMADKDLFAAARFPECPEGSSISAPSQTS

VDVSLIQDVERILDYSLCQETWSKIRAGLPISPVDLSYLAPKNPGTG

PAFTIINGTLKYFETRYIRVDIAAPILSRMVGMISGTTTERELWDDW

APYEDVEIGPNGVLRTSSGYKFPLYMIGHGMLDSDLHLSSKAQVFEH

PHIQDAASQLPDDESLFFGDTGLSKNPIELVEGWFSSWKSSIASFFF

IIGLIIGLFLVLRVGIHLCIKLKHTKKRQIYTDIEMNRLGK;

Ecotropic envelope protein from Moloney Murine
Leukemia Virus or "Eco"
(SEQ ID NO: 308)
MARSTLSKPLKNKVNPRGPLIPLILLMLRGVSTASPGSSPHQVYNIT

WEVTNGDRETVWATSGNHPLWTWWPDLTPDLCMLAHHGPSYWGLEYQ

-continued

SPFSSPPGPPCCSGGSSPGCSRDCEEPLTSLTPRCNTAWNRLKLDQT
THKSNEGFYVCPGPHRPRESKSCGGPDSFYCAYWGCETTGRAYWKPS
SSWDFITVNNNLTSDQAVQVCKDNKWCNPLVIRFTDAGRRVTSWTTG
HYWGLRLYVSGQDPGLTFGIRLRYQNLGPRVPIGPNPVLADQQPLSK
PKPVKSPSVTKPPSGTPLSPTQLPPAGTENRLLNLVDGAYQALNLTS
PDKTQECWLCLVAGPPYYEGVAVLGTYSNHTSAPANCSVASQHKLTL
SEVTGQGLCIGAVPKTHQALCNTTQTSSRGSYYLVAPTGTMWACSTG
LTPCISTTILNLTTDYCVLVELWPRVTYHSPSYVYGLFERSNRHKRE
PVSLTLALLLGGLTMGGIAAGIGTGTTALMATQQFQQLQAAVQDDLR
EVEKSISNLEKSLTSLSEVVLQNRRGLDLLFLKEGGLCAALKEECCF
YADHTGLVRDSMAKLRERLNQRQKLFESTQGWFEGLFNRSPWFTTLI
STIMGPLIVLLMILLFGPCILNRLVQFVKDRISVVQALVLTQQYHQL
KPIEYEP;

Amphotropic Murine Leukemia Virus Envelope 4070A
(SEQ ID NO: 309)
MARSTLSKPPQDKINPWKPLIVMGVLLGVGMAESPHQVFNVTWRVTN
LMTGRTANATSLLGTVQDAFPKLYFDLCDLVGEEWDPSDQEPYVGYG
CKYPAGRQRTRTFDFYVCPGHTVKSGCGGPGEGYCGKWGCETTGQAY
WKPTSSWDLISLKRGNTPWDTGCSKVACGPCYDLSKVSNSFQGATRG
GRCNPLVLEFTDAGKKANWDGPKSWGLRLRYRTGTDPITMFSLTRQVL
NVGPRVPIGPNPVLPDQRLPSSPIEIVPAPQPPSPLNTSYPPSTTST
PSTSPTSPSVPQPPPGTGDRLLALVKGAYQALNLTNPDKTQECWLCL
VSGPPYYEGVAVVGTYTNHSTAPANCTATSQHKLTLSEVTGQGLCMG
AVPKTHQALCNTTQASGSGSYYLAAPAGTMWACSTGLTPCLSTTVLN
LTTDYCVLVELWPRVIYHSPDYMYGQLEQRTKYKREPVSLTLALLLG
GLTMGGIAAGIGTGTTALIKTQQFEQLHAAIQTDLNEVEKSITNLEK
SLTSLSEVVLQNRRGLDLLFLKEGGLCAALKEECCFYADHTGLVRDS
MAKLRERLNQRQKLFETGQGWFEGLFNRSPWFTTLISTIMGPLIVLL
LILLFGPCILNRLVQFVKDRISVVQALVLTQQYHQLKPIEYEP;

Sindbis virus E3-E2-6K-E1 envelope polyprotein
(SEQ ID NO: 310)
SAAPLVTAMCLLGNVSFPCDRPPTCYTREPSRALDILEENVNHEAYD
TLLNAILRCGSSGRSKRSVIDDFTLTSPYLGTCSYCHHTVPCFSPVK
IEQVWDEADDNTIRIQTSAQFGYDQSGAASANKYRYMSLKQDHTVKE
GTMDDIKISTSGPCRRLSYKGYFLLAKCPPGDSVTVSIVSSNSATSC
TLARKIKPKFVGREKYDLPPVHGKKIPCTVYDRLKETTAGYITMHRP
RPHAYTSYLEESSGKVYAKPPSGKNITYECKCGDYKTGTVSRTEIT
GCTAIKQCVAYKSDQTKWVFNSPDLIRHDDHTAQGKLHLPFKLIPST
CMVPVAHAPNVIHGFKHISLQLDTDHLTLLTTRRLGANPEPTTEWIV
GKTVRNFTVDRDGLEYIWGNHEPVRVYAQESAPGDPHGWPHEIVQHY
YHRHPVYTILAVASATVAMMIGVTVAVLCACKARRECLTPYALAPNA
VIPTSLALLCCVRSANAETFTETMSYLWSNSQPFFWVQLCIPLAAFI
VLMRCCSCCLPFLVVAGAYLAKVDAYEHATTVPNVPQIPYKALVERA -continued GYAPLNLEITVMSSEVLPSTNQEYITCKFTTVVPSPKIKCCGSLECQ
PAAHADYTCKVFGGVYPFMWGGAQCFCDSENSQMSEAYVELSADCAS
DHAQAIKVHTAAMKVGLRIVYGNTTSFLDVYVNGVTPGTSKDLKVIA
GPISASFTPFDHKVVIHRGLVYNYDFPEYGAMKPGAFGDIQATSLTS
KDLIASTDIRLLKPSAKNVHVPYTQASSGFEMWKNNSGRPLQETAPF
GCKIAVNPLRAVDCSYGNIPISIDIPNAAFIRTSDAPLVSTVKCEVS
ECTYSADFGGMATLQYVSDREGQCPVHSHSSTATLQESTVHVLEKGA
VTVHFSTASPQANFIVSLCGKKTTCNAECKPPADHIVSTPHKNDQEF
QAAISKTSWSWLFALFGGASSLLIIGLMIFACSMMLTSTRR;

Ebola GP (Zaire Mayinga strain)
(SEQ ID NO: 311)
MGVTGILQLPRDRFKRTSFFLWVIILFQRTFSIPLGVIHNSTLQVSD
VDKLVCRDKLSSTNQLRSVGLNLEGNGVATDVPSATKRWGFRSGVPP
KVVNYEAGEWAENCYNLEIKKPDGSECLPAAPDGIRGFPRCRYVHKV
SGTGPCAGDFAFHKEGAFFLYDRLASTVIYRGTTFAEGVVAFLILPQ
AKKDFFSSHPLREPVNATEDPSSGYYSTTIRYQATGFGTNETEYLFE
VDNLTYVQLESRFTPQFLLQLNETIYTSGKRSNTTGKLIWKVNPEID
TTIGEWAFWETKKNLTRKIRSEELSFTVVSNGAKNISGQSPARTSSD
PGTNTTTEDHKIMASENSSAMVQVHSQGREAAVSHLTTLATISTSPQ
SLTTKPGPDNSTHNTPVYKLDISEATQVEQHHRRTDNDSTASDTPSA
TTAAGPPKAENTNTSKSTDFLDPATTTSPQNHSETAGNNNTHHQDTG
EESASSGKLGLITNTIAGVAGLITGGRRTRREAIVNAQPKCNPNLHY
WTTQDEGAAIGLAWIPYFGPAAEGIYIEGLMHNQDGLICGLRQLANE
TTQALQLFLRATTELRTFSILNRKAIDFLLQRWGGTCHILGPDCCIE
PHDWTKNITDKIDQIIHDFVDKTLPDQGDNDNWWTGWRQWIPAGIGV
TGVIIAVIALFCICKFVF;

Human Immunodeficiency Virus envelope
glycoprotein precursor gp160
(SEQ ID NO: 312)
MRVKEKYQHLWRWGWKWGIMLLGILMICSATENLWVTVYYGVPVWKE
ATTTLFCASDAKAYDTEVHNVCATHACVPTDPNPQEVILVNVTENFD
MWKNDMVEQMHEDIISLWDQSLKPCVKLTPLCVNLKCTDLKNDTNTN
SSNGRMIMEKGEIKNCSFNISTSIRNKVQKEYAFFYKLDIRPIDNTT
YRLISCNTSVITQACPKVSFEPIPIHYCAPAGFAILKCNDKTFNGTG
PCTNVSTVQCTHGIRPVVSTQLLLNGSLAEEEGVIRSANFTDNAKTI
IVQLNTSVEINCTRPNNNTRKSIRIQRGPGRAFVTIGKIGNMRQAHC
NISRAKWMSTLKQIASKLREQFGNNKTVIFKQSSGGDPEIVTHSFNC
GGEFFYCNSTQLFNSTWFNSTWSTEGSNNTEGSDTITLPCRIKQFIN
MWQEVGKAMYAPPISGQIRCSSNITGLLLTRDGGKNTNESEVFRPGG
GDMRDNWRSELYKYKVVKIETLGVAPTKAKRRVVQREKRAVGIGALF
LGFLGAAGSTMGAASMTLTVQARQLLSGIVQQQNNLLRAIEAQQHLL
QLTVWGIKQLQARILAVERYLKDQQLLGIWGCSGKLICTTAVPWNAS
WSNKSLEQFWNNMTWMEWDREINNYTSLIHSLIDESQNQQEKNEQEL -continued

LELDKWASLWNWFNITNWLWYIKIFIMIVGGLVGLRIVFAVLSIVNR

VRQGYSPLSFQTHLPNRGGPDRPEGIEEEGGERDRDRSVRLVNGSLA

LIWDDLRSLCLFSYHRLRDLLLIVTRIVELLGRRGWEALKYWWNLLQ

YWSQELKNSAVSLLNATAIAVAEGTDRVIEVVQGAYRAIRHIPRRIR

QGLERIL;

Respiratory Syncytial Virus F protein precursor
(SEQ ID NO: 313)
MELLILKANAITTILTAVTFCFASGQNITEEFYQSTCSAVSKGYLSA

LRTGWYTSVITIELSNIKENKCNGTDAKVKLIKQELDKYKNAVTELQ

LLMQSTPPTNNRARRELPRFMNYTLNNAKKTNVTLSKKRKRRFLGFL

LGVGSAIASGVAVSKVLHLEGEVNKIKSALLSTNKAVVSLSNGVSVL

TSKVLDLKNYIDKQLLPIVNKQSCSISNIETVIEFQQKNNRLLEITR

EFSVNAGVTTPVSTYMLTNSELLSLINDMPITNDQKKLMSNNVQIVR

QQSYSIMSIIKEEVLAYVVQLPLYGVIDTPCWKLHTSPLCTTNTKEG

SNICLTRTDRGWYCDNAGSVSFFPQAETCKVQSNRVFCDTMNSLTLP

SEINLCNVDIFNPKYDCKIMTSKTDVSSSVITSLGAIVSCYGKTKCT

ASNKNRGIIKTFSNGCDYVSNKGMDTVSVGNTLYYVNKQEGKSLYVK

GEPIINFYDPLVFPSDEFDASISQVNEKINQSLAFIRKSDELLHNVN

AGKSTTNIMITTIIIVIIVILLSLIAVGLLLYCKARSTPVTLSKDQL

SGINNIAFSN;

SARS Coronavirus spike protein
(SEQ ID NO: 314)
MFIFLLFLTLTSGSDLDRCTTFDDVQAPNYTQHTSSMRGVYYPDEIF

RSDTLYLTQDLFLPFYSNVTGFHTINHTFGNPVIPFKDGIYFAATEK

SNVVRGWVFGSTMNNKSQSVIIINNSTNVVIRACNFELCDNPFFAVS

KPMGTQTHTMIFDNAFNCTFEYISDAFSLDVSEKSGNFKHLREFVFK

NKDGFLYVYKGYQPIDVVRDLPSGFNTLKPIFKLPLGINITNFRAIL

TAFSPAQDIWGTSAAAYFVGYLKPTTFMLKYDENGTITDAVDCSQNP

LAELKCSVKSFEIDKGIYQTSNFRVVPSGDVVRFPNITNLCPFGEVF

NATKFPSVYAWERKKISNCVADYSVLYNSTFFSTFKCYGVSATKLND

LCFSNVYADSFVVKGDDVRQIAPGQTGVIADYNYKLPDDFMGCVLAW

NTRNIDATSTGNYNYKYRYLRHGKLRPFERDISNVPFSPDGKPCTPP

ALNCYWPLNDYGFYTTTGIGYQPYRVVVLSFELLNAPATVCGPKLST

DLIKNQCVNFNFNGLTGTGVLTPSSKRFQPFQQFGRDVSDFTDSVRD

PKTSEILDISPCSFGGVSVITPGTNASSEVAVLYQDVNCTDVSTAIH

ADQLTPAWRIYSTGNNVFQTQAGCLIGAEHVDTSYECDIPIGAGICA

SYHTVSLLRSTSQKSIVAYTMSLGADSSIAYSNNTIAIPTNFSISIT

TEVMPVSMAKTSVDCNMYICGDSTECANLLLQYGSFCTQLNRALSGI

AAEQDRNTREVFAQVKQMYKTPTLKYFGGFNFSQILPDPLKPTKRSF

IEDLLFNKVTLADAGFMKQYGECLGDINARDLICAQKFNGLTVLPPL

LTDDMIAAYTAALVSGTATAGWTFGAGAALQIPFAMQMAYRFNGIGV

TQNVLYENQKQIANQFNKAISQIQESLTTTSTALGKLQDVVNQNAQA

-continued

LNTLVKQLSSNFGAISSVLNDILSRLDKVEAEVQIDRLITGRLQSLQ

TYVTQQLIRAAEIRASANLAATKMSECVLGQSKRVDFCGKGYHLMSF

PQAAPHGVVFLHVTYVPSQERNFTTAPAICHEGKAYFPREGVFVFNG

TSWFITQRNFFSPQIITTDNTFVSGNCDVVIGIINNTVYDPLQPELD

SFKEELDKYFKNHTSPDVDLGDISGINASVVNIQKEIDRLNEVAKNL

NESLIDLQELGKYEQYIKWPWYVWLGFIAGLIAIVMVTILLCCMTSC

CSCLKGACSCGSCCKFDEDDSEPVLKGVKLHYT;

Influenza hemagglutinin
(SEQ ID NO: 315)
MKTIIALSYIFCLALGQDLPGNDNSTATLCLGHHAVPNGTLVKTITD

DQIEVTNATELVQSSSTGKICNNPHRILDGIDCTLIDALLGDPHCDV

FQNETWDLFVERSKAFSNCYPYDVPDYASLRSLVASSGTLEFITEGF

TWTGVTQNGGSNACKRGPGSGFFSRLNWLTKSGSTYPVLNVTMPNND

NFDKLYIWGIHHPSTNQEQTSLYVQASGRVTVSTRRSQQTIIPNIGS

RPWVRGLSSRISIYWTIVKPGDVLVINSNGNLIAPRGYFKMRTGKSS

IMRSDAPIDTCISECITPNGSIPNDKPFQNVNKITYGACPKYVKQNT

LKLATGMRNVPEKQTRGLFGAIAGFIENGWEGMIDGWYGFRHQNSEG

TGQAADLKSTQAAIDQINGKLNRVIEKTNEKFHQIEKEFSEVEGRIQ

DLEKYVEDTKIDLWSYNAELLVALENQHTIDLTDSEMNKLFEKTRRQ

LRENAEEMGNGCFKIYHKCDNACIESIRNGTYDHDVYRDEALNNRFQ

IKGVELKSGYKDWILWISFAISCFLLCVVLLGFIMWACQRGNIRCNI

CI

In other embodiments, the composition further comprises a non-viral cell-targeting polypeptide linked to the one or more transmembrane protein or membrane-anchored protein embedded in the lipid bilayer, wherein the non-viral cell-targeting polypeptide is displayed on an outer surface of the lipid bilayer. In various non-limiting embodiments, the non-viral cell-targeting polypeptide is selected from the group consisting of an immunoglobulin including but not limited to an scFv, a F(ab), a F(ab')$_2$, a B cell receptor (BCR), a DARPin, an affibody, a monobody, a nanobody, an antibody; a cell-targeting oligopeptide including but not limited to RGD integrin-binding peptides, and conotoxins.

Any suitable cell targeting polypeptides may be used in the compositions, depending on a recipient cell type of interest. In non-limiting embodiments, the cell targeting polypeptide targets mammalian cells, including but not limited to dendritic cells, macrophages, T cells, B cells, muscle cells, neurons, cancer cells, or stem cells.

The compositions disclosed herein may be present, for example, in cells that express the one or more active component and the recombinant polypeptides that self-assemble into the multimeric assemblies, leading to EPN formation after membrane scission is effected by recruiting the ESCRT machinery to the site of budding as described in detail below. Thus, in another embodiment is provided recombinant host cells capable of producing the composition of any embodiment or combination of embodiments of the invention. In one embodiment, the recombinant host cell comprises:

(a) one or more expression vectors capable of expressing the plurality of recombinant polypeptides that self-interact around at least one axis of rotational symmetry; and (b) an expression vector capable of expressing the one or more RNAs encoding a DNA binding protein, including but not limited to a genome editing protein, that is capable of being bound by the RBD.

In another embodiment, the recombinant host cell comprises:
(a) one or more expression vectors capable of expressing the plurality of recombinant polypeptides that self-interact around at least one axis of rotational symmetry;
(b) an expression vector capable of expressing the one or more gRNAs; and
(c) an expression vector capable of expressing the one or more mRNA encoding a Class 2 Cas protein and an RNA packaging sequence capable of being bound by the RBD.

In a further embodiment, the recombinant host cell comprises:
(a) one or more expression vectors capable of expressing the plurality of recombinant polypeptides that self-interact around at least one axis of rotational symmetry;
(b) one or more expression vector capable of expressing the one or more gRNAs; and
(c) one or more expression vector capable of expressing the Class 2 Cas protein.

In any of these embodiments, the recombinant host cell may further comprise one or more expression vector capable of expressing a cargo, a transmembrane or membrane-anchored protein, and/or a cell targeting polypeptide. In all of these embodiments, the recombinant expression vector may be cultured under suitable conditions to express the multimeric assemblies and the one or more active component of the compositions described herein, which may be present as separate entities in the cell, the one or more active component may be packaged in the multimeric assemblies in the recombinant cell, or both packaged and unpackaged (separate) embodiments may both be present within the recombinant cells.

As used herein, "capable of expressing" means that the recombinant polypeptides and one or more active component subunits are encoded by a nucleic acid in the expression vectors such that they are under the control of suitable control sequences operably linked to the coding sequence to effect transcription in the recombinant cell. "Control sequences" operably linked to the nucleic acid sequences of the disclosure are nucleic acid sequences capable of effecting the expression of the nucleic acid molecules. The control sequences need not be contiguous with the nucleic acid sequences, so long as they function to direct the expression thereof. Thus, for example, intervening untranslated yet transcribed sequences can be present between a promoter sequence and the nucleic acid sequences and the promoter sequence can still be considered "operably linked" to the coding sequence. Other such control sequences include, but are not limited to, polyadenylation signals, termination signals, and ribosome binding sites. Such expression vectors can be of any type known in the art, including but not limited to plasmid and viral-based expression vectors. The control sequence used to drive expression of the disclosed nucleic acid sequences in a mammalian system may be constitutive (driven by any of a variety of promoters, including but not limited to, CMV, SV40, RSV, actin, EF) or inducible (driven by any of a number of inducible promoters including, but not limited to, tetracycline, ecdysone, steroid-responsive). The construction of expression vectors for use in transfecting prokaryotic cells is also well known in the art, and thus can be accomplished via standard techniques. (See, for example, Sambrook, Fritsch, and Maniatis, in: Molecular Cloning, A Laboratory Manual, Cold Spring Harbor Laboratory Press, 1989; Gene Transfer and Expression Protocols, pp. 109-128, ed. E. J. Murray, The Humana Press Inc., Clifton, N.J.), and the Ambion 1998 Catalog (Ambion, Austin, TX). The expression vector must be replicable in the host organisms either as an episome or by integration into host chromosomal DNA. In non-limiting embodiments, the expression vector may comprise a plasmid or a viral vector.

The recombinant cells can be either prokaryotic (for large scale preparation of expression vectors) or eukaryotic, such as mammalian cells for carrying out the methods of the invention. The cells can be transiently or stably transfected; preferably stably transfected. Such transfection of expression vectors into prokaryotic and eukaryotic cells can be accomplished via any technique known in the art, including but not limited to standard bacterial transformations, calcium phosphate co-precipitation, electroporation, or liposome mediated-, DEAE dextran mediated-, polycationic mediated-, or viral mediated transfection or transduction. (See, for example, Molecular Cloning: A Laboratory Manual (Sambrook, et al., 1989, Cold Spring Harbor Laboratory Press; Culture of Animal Cells: A Manual of Basic Technique, $2^{nd}$ Ed. (R. I. Freshney. 1987. Liss, Inc. New York, NY).

In another aspect, the present disclosure provides recombinant nucleic acids encoding recombinant polynucleotides, polypeptides, or polypeptide compositions of the present disclosure. The isolated nucleic acid sequence may comprise RNA or DNA. Such recombinant nucleic acid sequences may comprise additional sequences useful for promoting expression and/or purification of the encoded nucleic acid or protein, including but not limited to polyA sequences, modified Kozak sequences, and sequences encoding epitope tags, export signals, and secretory signals, nuclear localization signals, and plasma membrane localization signals. It will be apparent to those of skill in the art, based on the teachings herein, what nucleic acid sequences will encode the recombinant polypeptides or polypeptide compositions of the disclosure.

In one embodiment, the recombinant nucleic acid encodes a gRNA and comprises:
(a) a first nucleic acid domain encoding an RNA guide sequence capable of binding to a target nucleic acid sequence;
(b) a second nucleic acid domain encoding an RNA packaging sequence at least 50%, 55%, 60%, 65%, 70%, 75%, 80%, 85%, 90%, 95%, 96%, 97%, 98%, 99%, or 100% identical to the sequence selected from the group consisting of SEQ ID NO: 204-207, and 329 and capable of being bound by an RNA binding domain; and
(c) a third nucleic acid domain encoding a structural sequence capable of binding to a Class 2 Cas protein to form a ribonucleoprotein complex.

In one embodiment, the structural sequence comprises or consists of a sequence that is at least 50% identical over its length to the nucleic acid sequence selected from the group consisting of SEQ ID NO: 332-335, wherein N is absent or comprises or consists of an RNA packaging sequence. In one embodiment, N is absent. In a further embodiment, N is present, and the RNA packaging sequence comprises or consists of a sequence that is at least 50%, 55%, 60%, 65%, 70%, 75%, 80%, 85%, 90%, 95%, 96%, 97%, 98%, 99%, or 100% over its length to the nucleic acid sequence selected from the group consisting of SEQ ID NOS: 204-207, and 329. In another embodiment, the recombinant nucleic acid has an arrangement selected from the group consisting of:

(a) the guide sequence is located 5' to the structural sequence in the gRNA, and wherein RNA packaging sequence is located 3' to the structural sequence in the gRNA (particularly compatible with Cas9 proteins); or
(b) the guide sequence is located 3' to the structural sequence in the gRNA, and wherein RNA packaging sequence is located 5' to the structural sequence in the gRNA (particularly compatible with Cpf1 proteins).

In another embodiment, the recombinant nucleic acid further comprises a fourth nucleic acid domain that encodes an RNA stabilization sequence. In one embodiment, the RNA stabilization sequence comprises or consists of the sequence of SEQ ID NO:336.

In a further embodiment, the recombinant nucleic acid encodes a sequence that is at least 50%, 55%, 60%, 65%, 70%, 75%, 80%, 85%, 90%, 95%, 96%, 97%, 98%, 99%, or 100% over its length to the nucleic acid sequence selected from the group consisting of SEQ ID NOS:337-361 and 411-414.

In another embodiment, the recombinant nucleic acid encodes an RNA expression produce comprising a DNA binding protein linked to one or more RNA packaging sequence capable of being bound by an RNA binding domain, wherein the one or more RNA packaging sequence is located 5' to the RNA encoding a DNA binding protein, 3' to the RNA encoding a DNA binding protein, or both. In one embodiment, the RNA packaging sequence comprises or consists of a sequence that is at least 50%, 55%, 60%, 65%, 70%, 75%, 80%, 85%, 90%, 95%, 96%, 97%, 98%, 99%, or 100% over its length to the nucleic acid sequence selected from the group consisting of SEQ ID NOS: 204-207, and 329. In another embodiment, the DNA binding protein is selected from the group consisting of RNAs encoding a zinc finger DNA binding protein, Transcription Activator-Like Effector (TALE) protein, meganuclease, recombinase, integrase, transposase, single-stranded DNA binding protein, and nucleotide-modifying protein, or a deaminase. In another embodiment, the recombinant nucleic acid encodes a protein comprising the amino acid sequence selected from the group consisting of SEQ ID NO:368-369. In a further embodiment, the recombinant nucleic acid encodes the RNA sequence selected from the group consisting of SEQ ID NOS: 373-378.

In another embodiment is provided recombinant expression vectors comprising the recombinant nucleic acid of any embodiment or combination of embodiments disclosed herein operably linked to a suitable control sequence, such as a promoter. In a further embodiment is provided recombinant host cells comprising the recombinant expression vectors described above.

In a further aspect, the disclosure provides methods a gene regulation method comprising:
(a) expressing in producer cells the composition of any embodiment or combination of embodiments of the disclosure, such that the DNA binding protein, the RNA encoding a Class 2 Cas protein, and/or the Class 2 Cas protein-containing RNP complexes are packaged in the membrane envelope of the producer cell to produce a gene regulation vesicle;
(b) purifying the gene regulation vesicle from the producer cells; and
(c) incubating the gene regulation vesicle with recipient cells for delivery of the DNA binding protein, the RNA encoding Class 2 Cas protein, and/or the Class 2 Cas protein-containing RNP complexes, wherein gene regulation by the DNA binding protein and/or the Class 2 Cas protein occurs in the recipient cell.

In this embodiment, the methods comprising culturing the recombinant host producer cells of the disclosure (eukaryotic cells, such as mammalian cells) under conditions suitable to promote expression of the polypeptide and one or more active component, resulting in producing multimeric assemblies in which the one or more active component is packaged (EPN), and interaction of one or more of the M domains of the multimeric assembly with the lipid bilayer membrane of the producer cell, wherein attachment of the one or more M domains of the multimeric assembly to the lipid bilayer membrane of the producer cell results in the multimeric assembly being enveloped by eukaryotic host-derived lipid bilayer membrane to form the EPN, followed by recruitment of the ESCRT machinery to the site of budding by the L domains of the multimeric assembly, which releases the EPN (referred to here as the "gene regulation vesicle") from the producer by catalyzing membrane scission. These gene regulation vesicles are then purified using any suitable technique, including but not limited to centrifugation and/or filtration, and incubated under suitable conditions with the recipient cells. Incubating the gene regulation vesicles with recipient cells leads to delivery of the DNA binding protein, the RNA encoding Class 2 Cas protein, and/or the Class 2 Cas protein-containing RNP complexes, and results in gene regulation by the DNA binding protein and/or the Class 2 Cas protein occurs in the recipient cell. In one embodiment, the contents of the gene regulation vesicle are released from an endosome in the recipient cell. By way of non-limiting example, the transmembrane domain may comprise a viral fusion protein (e.g., VSV-G) to fuse the vesicle membrane with the cell's endosomal membrane. This results in translocation of the vesicle contents (the EPN and the packaged genome editing protein/complex/macromolecule) into the cytoplasm of the recipient cell.

In these methods, the M domain chosen for use may be one that binds to the membrane of the eukaryotic host cell to be used for expression, and the L domain chosen for use may be one that binds to interacts directly or indirectly with protein subunits of the host cell ESCRT complex, or interacts with proteins of the host cell known to recruit the ESCRT complex of the host cell to sites of budding.

The type of gene regulation effected will depend on the DNA binding protein and/or the Class 2 Cas protein used, and includes but is not limited to gene editing, gene activation, and gene silencing. In light of the teachings herein it is well within the level of those of skill in the art to determine which RNA encoding a DNA binding protein or Class 2 Cas protein to use in the methods disclosed herein based on an intended use. Similarly, determining appropriate incubation conditions is well within the level of those of skill in the art based on the teachings herein and in light of the specific recipient cells of interest. In various embodiments,
the recipient cells are eukaryotic cells, such as mammalian cells (including but not limited to mouse cells or human cells). Non-limiting embodiments of recipient cells include T cells, dendritic cells, macrophages, stem cells, HEK293T cells, telomerase-immortalized human fibroblasts (tertHF), and THP-1 cells.

Example 1. EPN Design

Computational Design of I3-01, a Self-Assembling Protein Icosahedron

The I3-01 polypeptide sequence (SEQ ID 20) was designed using the method of King et al. (Neil P King, William Sheffler, Michael R Sawaya, Breanna S Vollmar, John P Sumida, Ingemar Andre, Tamir Gonen, Todd O Yeates, David Baker (2012) Computational design of self-assembling protein nanomaterials with atomic level accuracy. Science 336:1171-1174; Neil P King, Jacob B Bale, William Sheffler, Dan E McNamara, Shane Gonen, Tamir Gonen, Todd O Yeates, David Baker (2014) Accurate design of co-assembling multi-component protein nanomaterials. Nature 510:103-108; U.S. Pat. No. 8,969,521; WO2014/124301) See also WO2016/138525, incorporated by reference herein it is entirety). The structure of the trimeric 2-keto-3-deoxy-6-phosphogluconate (KDPG) aldolase from *Thermotoga maritima* (SEQ ID 21; PDB entry 1wa3) was used as the starting point for design in combination with a symmetry definition file suitable for modeling a 60-subunit icosahedral assembly constructed from trimeric building blocks. The designed polypeptide sequence was predicted to spontaneously assemble to a 60-subunit multimeric assembly with icosahedral symmetry when expressed recombinantly. The assembly process was predicted to be driven by the low-energy, inter-trimer protein-protein interface designed computationally (O interface), which comprises five mutations from the natural sequence (1wa3-wt; SEQ ID 21) in addition to several amino acids that remained unchanged from the natural sequence.

Recombinant Expression and Purification of I3-01

A synthetic gene encoding the designed protein I3-01 was constructed and cloned into a bacterial expression vector. *E. coli* cells expressing I3-01 were lysed, and the protein was purified by ammonium sulfate precipitation, heating, and size exclusion chromatography. The *E. coli* cells were resuspended in 25 mM Tris, 150 mM NaCl, pH 8.0 supplemented with 1 mM PMSF, 1 mg/mL DNase, and 1 mg/mL lysozyme and lysed by sonication. The lysates were clarified by centrifugation (20,000×g for 25 minutes at 4° C.) and protein was precipitated by the addition of ammonium sulfate to 60% saturation. The pellet was collected by centrifugation (20,000×g for 15 minutes at 25° C.) and resuspended in 25 mM Tris, 150 mM NaCl, pH 8.0. The solution was heated at 80° C. for 10 minutes, and insoluble material was pelleted by centrifugation (20,000×g for 15 minutes at 4° C.). The supernatant was concentrated using a centrifugal filtration device prior to size exclusion chromatography on an AKTA Pure system equipped with a Superose 6 10/300 column (GE Healthcare). Fractions containing pure protein in the assembled (icosahedral) state were collected and concentrated using a centrifugal filtration device.

Characterization of the Oligomerization State of I3-01

Purified I3-01 eluted from the Superose 6 column as a single peak with an apparent size of about 60 subunits. In contrast, 1wa3-wt as well as a variant of I3-01 in which the leucine at position 33 was mutated to arginine [I3-01 (L33R)] both eluted in the expected trimeric state). The L33R mutation was predicted to disrupt the designed O interface in I3-01 by introducing steric bulk that could not be accommodated. The observation that this mutation indeed disrupted assembly of I3-01 indicated that the designed O interface drives assembly of the protein to the designed icosahedral oligomeric assembly. We also observed that I3-01 migrates more slowly than 1wa3-wt and I3-01(L33R) during non-denaturing (native) polyacrylamide gel electrophoresis (PAGE) of the three proteins, which provided additional support that I3-01 self-assembles to a higher-order oligomerization state. Finally, visualization of I3-01 by cryo-electron microscopy revealed monodisperse particles of the expected size and shape, and class averages derived from the cryo-electron micrographs closely resembled projections calculated from the I3-01 computational design model, demonstrating that I3-01 assembles to the designed icosahedral multimeric assembly in solution.

Design of Enveloped Protein Nanocages

We hypothesized that the minimal requirements for efficient release from cells of multimeric protein assemblies enveloped in a lipid bilayer membrane were threefold. First, the multimeric protein assembly must interact with a cellular membrane bilayer. Second, the multimeric protein assembly must deform the membrane to form a bud structure by virtue of its interaction with the membrane and its multimerization through the interactions of its O interfaces. Third, the multimeric protein assembly must recruit cellular factors such as the ESCRT complexes to catalyze the fission of the membrane neck between the bud and the cell, thereby effecting release of the multimeric protein assembly from the cell in the form of an enveloped protein nanoparticle. Protein constructs for providing multimeric protein assemblies comprising functional elements that meet all three criteria are hereafter be referred to as enveloped protein nanocages (EPN). The EPNs comprise proteins comprising M domains that interact with a cellular membrane, O interfaces that drive assembly of the multimeric protein assemblies and therefore membrane deformation, and L domains that recruit cellular factors for catalyzing membrane fission. As the examples below demonstrate, a variety of M domains, O interfaces, and L domains can be used, as long as each domain or interface demonstrably performs its required function and protein subunit of each multimeric protein assembly comprises at least one O interface and one L domain, and each multimeric protein assembly comprises at least one M domain.

A first series of constructs for providing EPNs was designed using the I3-01 polypeptide to provide the O interface. In this series of constructs, a variety of M domains and L domains were genetically fused to the I3-01 sequence.

In one embodiment (SEQ ID 227; Myr-I3-01-myc-p6), the N-terminal six amino acids of the HIV Gag protein were fused to the N terminus of I3-01 via a flexible linker to provide an M domain and the p6 domain of the HIV Gag protein was fused to the C terminus of I3-01 to provide an L domain; the construct also includes a myc tag to facilitate specific detection of the protein using anti-myc antibodies.

In another embodiment (SEQ ID 228; Late2-4GS-I3-01-10GS-PH-flag), 22 residues of the Ebola VP40 protein encompassing the polypeptide motif PTAPPEY, which is known to recruit the ESCRT pathway to facilitate the budding and release of Ebola from host cells, were fused to the N terminus of I3-01 to provide an L domain and the pleckstrin homology (PH) domain of the rat phospholipase C-δ1 protein was fused to the C terminus of I3-01 to provide an M domain; the construct also includes a FLAG tag to facilitate specific detection of the protein using anti-FLAG antibodies.

Initial Identification of EPNs Using the Budding Assay

To quantify release of I3-01-derived EPNs from cells, HEK293T cells (8×10$^5$/well) were seeded in 6 well plates 24 h prior to transfection. Cells were transfected with 2.5 μg of plasmid DNA expressing I3-01-based constructs using LIPOFECTAMINE® 2000 (Invitrogen) following the manufacturer's instructions. Cells and culture supernatants were harvested 24 h post transfection. EPNs were collected from the culture supernatants by centrifugation through a 20% sucrose cushion for 90 min at 21,000×g at 4° C. Cells were lysed in cold lysis buffer (50 mM Tris pH 7.4, 150 mM NaCl, 1% Triton X-100, protease inhibitors) and lysates were cleared by centrifugation for 5 min, 16,000×g, 4° C. Triton-insoluble material was solubilized in 2× Laemmli sample buffer by boiling for 10 min. The Triton-soluble and insoluble cellular fractions as well as the pelleted EPNs boiled in 1× Laemmli sample buffer were separated by 12% SDS-PAGE gels, transferred onto PVDF membranes, and probed with antibodies against the myc and/or FLAG tags. The presence of I3-01-based proteins in the culture supernatants pelleted through a 20% sucrose cushion suggests release of the proteins in the form of EPNs. Quantities of myc-tagged I3-01-based proteins in each fraction were measured using a standard curve generated with known amounts of recombinant, non-enveloped Myr-I3-01-myc-p6 protein produced in *E. coli*. Bacteria have neither ESCRT nor N-myristoyltransferase, both necessary for the budding and release of Myr-I3-01-myc-p6 as an EPN, and therefore Myr-I3-01-myc-p6 produced in *E. coli* forms a non-enveloped icosahedral multimeric assembly that resembles I3-01 by size exclusion chromatography and negative stain electron microscopy.

Whereas Myr-I3-01-myc-p6 and Late2-4GS-I3-01-10GS-PH-flag were found in the pelleted culture supernatants, unmodified I3-01 was not detectable in the pelleted culture supernatant. This result indicated that Myr-I3-01-myc-p6 and Late2-4GS-I3-01-10GS-PH-flag were released from cells as EPNs due to the additional functional domains they comprise relative to unmodified I3-01. Typical release levels for Myr-I3-01-p6 were roughly 100 µg/$10^6$ cells.

Although Myr-I3-01-myc-p6 was designed to comprise a myristoylation motif (the 6 N-terminal amino acids of HIV Gag) to function as the M domain on each protein subunit in the multimeric assembly, during the course of our characterization of the protein we discovered that the M domain was only present on about half of the protein subunits in each multimeric assembly. Myr-I3-01-myc-p6 migrates as two distinct but closely spaced bands (a "doublet") of equal intensity on SDS-PAGE or Western blots. Upon mutation of a methionine residue at the N terminal end of the I3-01 O domain to isoleucine, the new protein (EPN-01) migrated as a single band. This result demonstrates that the two bands observed in the Myr-I3-01-myc-p6 doublet were in fact two different molecules, one the full-length protein and one a truncated version of the same protein that lacked the N-terminal M domain and linker (SEQ ID NO: 317) due to the initiation of translation by the ribosome at the internal start codon. EPN-01—which bears the N-terminal M domain and linker on each subunit of the multimeric assembly—and Myr-I3-01-myc-p6 behave identically in terms of the ability to bud and be released from cells, package cargoes, be pseudotyped with viral envelope proteins, deliver cargoes to the cytoplasm of recipient cells, and appear to be indistinguishable structurally. This result demonstrates that not every subunit in a multimeric assembly needs to comprise an M domain, so long as the plurality of M domains in the multimeric assembly are adequate to drive association with the membrane and/or result in deformation of the lipid bilayer upon multimerization.

The budding and release of several mutants of EPN-01 were also evaluated using the budding assay described above in order to test the hypothesis that all three functions—membrane binding, multimerization, and recruitment of host factors for membrane scission—are necessary to effect efficient budding and release of EPNs. A G2A mutant of EPN-01 [Myr-I3-01-myc-p6(G2A)] that eliminates the ability of the M domain to be myristoylated (Freed E O, Orenstein J M, Buckler-White A J, Martin M A (1994) Single amino acid changes in the human immunodeficiency virus type 1 matrix protein block virus particle production. J. Virol. 68:5311-20) was used to test the requirement for membrane interaction. A variant containing the L33R mutation described above [EPN-01(L33R)] was used to test the requirement for higher-order multimerization to enhance membrane binding and/or induce membrane deformation. Three variants were made to test the requirement for recruitment of ESCRT to catalyze membrane fission. The p6 domain of the HIV Gag protein is known to contain at least two linear polypeptide motifs, PTAP (SEQ ID NO: 167) and YPLTSL (SEQ ID NO: 169), that respectively interact with Tsg101 and ALIX, proteins involved in the recruitment of proteins in the ESCRT pathway to the site of budding (McCullough J, Colf L A, Sundquist W I (2013) Membrane Fission Reactions of the Mammalian ESCRT Pathway. Annu. Rev. Biochem. 82:663-92; Bieniasz P D (2006) Late budding domains and host proteins involved in enveloped virus release. Virology 344:55-63). Therefore, variants in which the polypeptide motif PTAP (SEQ ID NO: 167) was mutated to AAAA (SEQ ID NO: 316) [EPN-01(ΔPTAP)], the YP dipeptide of the polypeptide motif YPLTSL (SEQ ID NO: 169) was mutated to AA [EPN-01(ΔYP)], or both motifs were simultaneously mutated [EPN-01 (ΔPTAP/ΔYP)] were used to test the requirement for the recruitment of ESCRT to catalyze membrane fission. Mutation of these motifs in various retroviruses has been previously shown to disrupt ESCRT-dependent virus budding and release (Bieniasz P D (2006) Late budding domains and host proteins involved in enveloped virus release. Virology 344:55-63, and references cited therein). Results of the budding assay with these variants of EPN-01 confirmed that the presence of all three functional elements is required for efficient budding and release of EPNs. EPN-01(G2A) and EPN-01(L33R) were both undetectable in the pelleted culture supernatants, indicating that the functions of membrane binding and multimerization provided by the M domain and O interface are necessary for efficient budding and release. The release of EPN-01(ΔPTAP) from cells was significantly reduced, the release of EPN-01(ΔYP) was more significantly reduced, and the release of EPN-01(ΔPTAP/ΔYP) was undetectable, demonstrating that recruitment of ESCRT by an L domain comprising one or more polypeptide motifs known to interact directly or indirectly with proteins of the ESCRT pathway is also necessary for budding and release. Together, these results confirm the requirement for all three functional elements—membrane binding, multimerization, and recruitment of host factors for membrane scission—for efficient budding and release of EPNs.

SEQ ID 317 (truncated variant of Myr-I3-01-myc-p6 lacking N-terminal M domain and linker)

MEELFKKHKIVAVLRANSVEEAKKKALAVFLGGVHLIEITFTVPDADT

VIKELSFLKEMGAIIGAGTVTSVEQCRKAVESGAEFIVSPHLDEEISQ

FCKEKGVFYMPGVMTPTELVKAMKLGHTILKLFPGEVVGPQFVKAMKG

PFPNVKFVPTGGVNLDNVCEWFKAGVLAVGVGSALVKGTPVEVAEKAK

AFVEKIRGCTE(QKLISEEDL)QSRPEPTAPPEESFRSGVETTTPPQK

QEPIDKELYPLTSLRSLFGNDPSSQ.

Visualization of Myr-I3-01-Myc-p6 and EPN-01 by Electron Cryo-Tomography (ECT)

Extracellular vesicles were purified from culture supernatants of HEK293T cells (2×$10^6$ per 10 cm dish, up to 36 dishes seeded 24 h prior to transfection) that were transiently transfected with a plasmid encoding Myr-I3-01-myc-p6 or EPN-01 using $CaPO_4$. Transfected cells were incubated overnight before media was replaced with exosome production media (D-MEM supplemented with 10% FBS, depleted from contaminating extracellular particles by centrifugation overnight at 100,000×g at 4° C. and subsequently filtered through a 0.22 μm filter) and cells were grown for another 24 h. Extracellular vesicles released from cells were purified by a series of filtering and centrifugation steps (adapted from (Théry C, Clayton A, Amigorena S, Raposo G (2006) Isolation and Characterization of Exosomes from Cell and Culture Supernatants and Biological Fluids. Current Protocols in Cell Biology 3.22.1-3.22.19)). Cell debris was removed by centrifugation of the supernatant at 1,000×g for 5 min followed by filtering through a 0.22 μm filter. Extracellular vesicles were collected by centrifugation at 100,000×g in a SW32Ti (BeckmanCoulter) at 4° C. for at least 1 h. Pellets were resuspended in PBS and pooled in one tube (SW41 rotor, BeckmanCoulter). PBS was added to fill the tube completely and vesicles were collected by centrifugation at 100,000×g at 4° C. for at least 1 h. Pellets were resuspended in 1 ml of PBS and finally concentrated by centrifugation 100,000×g at 4° C. for at least 1 h in a tabletop ultracentrifuge using a TLS-55 rotor.

To prepare samples for ECT, 3 μl of purified vesicles in PBS were mixed with 3 μl of BSA coated gold fiducials (10 nm size, Electron Microscopy Sciences). 3.5 μl of the suspension was applied to a glow discharged 2/2 holey carbon coated EM grid (Quantifoil), which was previously placed in the environmental chamber of a Mark Vitrobot (FEI) maintained at 4° C., 80% relative humidity. Excess liquid was blotted for 7.5 s (0 mm offset) from the grids before plunge freezing in liquid ethane. Cryo-grids were then imaged in a 200 kV Tecnai TF20 microscope equipped with a K2 summit direct electron detector (Gatan). Tilt series were recorded bidirectionally starting from 0° to ±60° using a 1° step size at a magnification of 22,500× and a defocus of −8 μm (total dose per specimen was ~150 e−/Å). Image alignment and tomogram reconstructions were done using the IMOD software package (Kremer J. R., D. N. Mastronarde and J. R. McIntosh (1996) Computer visualization of three-dimensional image data using IMOD. J. Struct. Biol. 116:71-76).

Multiple icosahedral structures ~25 nm in diameter incorporated within larger membrane envelopes were observed in the pelleted culture supernatant from cells transfected with either Myr-I3-01-myc-p6 or EPN-01. The assemblies appear to be located primarily at the membrane of the vesicles, suggesting that they interact directly with the membrane via the M domain. Together with the results from the budding assay, these observations indicate that multimeric assemblies of Myr-I3-01-myc-p6 and EPN-01 are incorporated within large membrane-bounded vesicles that contain multiple multimeric assemblies.

EPNs are Highly Modular

After our initial success in designing EPNs, we screened a large set of candidate EPNs (51 different constructs) to explore the modularity and generality of the platform. The first 48 EPN constructs all use I3-01 as the self-assembly or oligomerization (O) domain, but both the identities and locations of the membrane interaction (M) domain and the ESCRT recruitment (L) domain vary among the constructs. Various classes of membrane interaction domains were included in the set: myristoylation motifs, N-terminal palmitoylation motifs, C-terminal palmitoylation motifs, and four different types of globular protein domains that bind to various lipid polar head groups (PH, PX, C1, and C2 domains). ESCRT recruitment domains used in the set vary from intact viral late domains (e.g., the p6 domain of HIV Gag) to peptide motifs as small as four amino acids known to play a key role in the protein-protein interactions that recruit ESCRT to sites of virus budding in vivo (e.g., PTAP). We also included in the set several constructs in which the L domain was omitted or mutations were made to inhibit membrane interactions in the M domain; these negative control constructs were not expected to bud and be released from cells as EPNs.

To facilitate the screening of the 51 constructs, we developed two biochemical assays that provide rapid assessments of both the yield of a given EPN as well as the integrity of the EPN membrane envelope. Both are based on the principle that an intact membrane envelope will prevent access of an added molecule to the protein subunits of the EPN, while the addition of detergent will enable access by disrupting the integrity of the membrane. In the first assay, trypsin was incubated with EPNs in the presence or absence of detergent and proteolysis of the protein subunits of the EPN was evaluated by Western blot. Lack of proteolysis in the sample without detergent indicated that the protein subunits of the EPN were not accessible to trypsin. Proteolysis in the presence of trypsin and detergent indicated that the protein subunits of the EPN no cage are accessible to trypsin. Therefore, detergent-dependent proteolysis demonstrated that the membrane envelope was intact in the absence of detergent and responsible for preventing trypsin access. The second assay made use of a previously described spectrophotometric enzyme assay (Griffiths J S, Wymer N J, Njolito E, Niranjanakumari S, Fierke C A, Toone E J (2002), Bioorganic & Medicinal Chemistry 10:545-50). The assay was specific for EPNs comprising I3-01 as the oligomerization (O) domain because it takes advantage of the fact that I3-01 was designed using a trimeric KDPG aldolase as the scaffold protein and the enzymatic activity is retained in the icosahedral multimeric assembly. Because the substrate KDPG is unable to cross lipid membranes, detergent-dependent enzymatic activity provided another readout for membrane integrity.

The day of transfection, 1 mL of HEK293F (Invitrogen) cells were plated at $2.5 \times 10^6$ cells/mL in 12-well plates. Cells were transfected with 1 μg of plasmid DNA encoding EPN constructs using EXPIFECTAMINE® 293 Reagent (Invitrogen) following the manufacturer's instructions. Cells and culture supernatants were harvested 40-48 h post transfection by centrifugation at 1000×g for 5 min at 4° C. to pellet the cells. Culture supernatants were then filtered through 0.45 μm filters (Millipore) and EPNs were collected by centrifugation through a 20% sucrose cushion for 2 h at 21,000×g at 4° C. Pelleted EPNs were resuspended in phosphate buffered saline (PBS). For the protease assay, aliquots of the resuspended EPNs were incubated for 30 min at room temperature with Trypsin-EDTA (Gibco) with the trypsin at a final concentration of 50 μg/mL in the presence or absence of 1% Triton X-100 (Sigma). After 30 min, freshly prepared phenylmethanesulfonyl fluoride (PMSF) trypsin inhibitor was added to trypsin-containing samples to a final concentration of 1 mM. Samples of the cell pellets, resuspended EPNs, EPNs+trypsin, and enveloped protein nanocages+trypsin+triton were mixed with Laemmli Sample Buffer, boiled for 10 minutes at 95° C., and analyzed by Western blot using an anti-myc primary antibody (9B11, Cell Signaling Technology). The enzyme assay was performed in 25 mM HEPES pH 7.0, 20 mM NaCl in the presence of NADH (0.1 mM), L-lactate dehydrogenase (0.11 U/μL), and 2-keto-3-deoxy-6-phosphogluconate (KDPG, 1 mM) at 25° C. Aliquots of the resuspended EPNs were added to reaction mixtures in the presence or absence of 1% Triton X-100 and enzyme activity was measured by monitoring the loss of absorbance at 339 nm due to oxidation of the NADH cofactor.

Screening of the first 48 EPNs that use I3-01 as the oligomerization (O) domain using the protease and enzyme activity assays described above demonstrated that 22 of the EPNs were released from cells in enveloped form with intact membrane envelopes (Table 3). Another 9 EPNs were released into the cell supernatant but did not appear to have fully intact membrane envelopes (that is, access of trypsin and/or KDPG to the subunits of the multimeric assemblies was detergent-independent); the reason for this is currently unclear. 17 out of the first 48 EPN constructs failed to be released into the cell supernatant; of these, 5 were designed as negative controls and were intended to not be released.

The three constructs that use O3-33 as the oligomerization (O) domain were also evaluated using the protease assay described above. One (EPN-49) was a negative control not intended to bud and be released from cells; one (EPN-50) was not released from cells; and one (EPN-51) was released from cells, pelleted through a 20% sucrose cushion, and underwent detergent-dependent proteolysis by trypsin, demonstrating that it formed an EPN of the disclosure. The 23 successful EPNs we have identified clearly demonstrate that the EPNs of the disclosure are general and highly modular in the sense that a wide variety of functional groups (M domains, O domains, and L domains) can be used to readily design new EPNs. Additionally, as described above, the inventors have provided assays that can be used to identify the EPNs of the disclosure.

TABLE 3

Summary of results from enzyme assay analyzing Myr-I3-01-myc-p6, I3-01, and EPNs 01-48.

| Construct | Enzyme activity | Conclusion |
|---|---|---|
| Myr-I3-01-myc-p6 | Detergent-dependent | Released from cells as an EPN |
| I3-01 (negative control) | None | Not released from cells |
| EPN-01 | Detergent-dependent | Released from cells as an EPN |
| EPN-02 (negative control) | None | Not released from cells |
| EPN-03 | Detergent-dependent | Released from cells as an EPN |
| EPN-04 | None | Not released from cells |
| EPN-05 | None | Not released from cells |
| EPN-06 | None | Not released from cells |
| EPN-07 | Detergent-dependent | Released from cells as an EPN |
| EPN-08 | Detergent-dependent | Released from cells as an EPN |
| EPN-09 | Detergent-dependent | Released from cells as an EPN |
| EPN-10 | Detergent-independent | Released from cells without an intact membrane |
| EPN-11 | Detergent-dependent | Released from cells as an enveloped protein nanocage |
| EPN-12 | None | Not released from cells |
| EPN-13 | Detergent-independent | Released from cells without an intact membrane |
| EPN-14 | Detergent-independent | Released from cells without an intact membrane |
| EPN-15 | None | Not released from cells |
| EPN-16 | None | Not released from cells |
| EPN-17 (negative control) | None | Not released from cells |
| EPN-18 | Detergent-dependent | Released from cells as an EPN |
| EPN-19 | Detergent-independent | Released from cells without an intact membrane |
| EPN-20 | Detergent-dependent | Released from cells as an EPN |
| EPN-21 | Detergent-independent | Released from cells without an intact membrane |
| EPN-22 | Detergent-independent | Released from cells without an intact membrane |
| EPN-23 | Detergent-dependent | Released from cells as an EPN |
| EPN-24 | Detergent-dependent | Released from cells as an EPN |
| EPN-25 | Detergent-dependent | Released from cells as an EPN |
| EPN-26 | Detergent-independent | Released from cells without an intact membrane |
| EPN-27 (negative control) | None | Not released from cells |
| EPN-28 | None | Not released from cells |
| EPN-29 | Detergent-independent | Released from cells without an intact membrane |
| EPN-30 (negative control) | None | Not released from cells |
| EPN-31 | None | Not released from cells |
| EPN-32 | None | Not released from cells |
| EPN-33 (negative control) | None | Not released from cells |
| EPN-34 | None | Not released from cells |
| EPN-35 | Detergent-independent | Released from cells without an intact membrane |
| EPN-36 | Detergent-dependent | Released from cells as an EPN |
| EPN-37 | Detergent-dependent | Released from cells as an EPN |
| EPN-38 | Detergent-dependent | Released from cells as an EPN |
| EPN-39 | Detergent-dependent | Released from cells as an EPN |
| EPN-40 | None | Not released from cells |
| EPN-41 | Detergent-dependent | Released from cells as an EPN |
| EPN-42 | Detergent-dependent | Released from cells as an EPN |
| EPN-43 | Detergent-dependent | Released from cells as an EPN |

TABLE 3-continued Summary of results from enzyme assay analyzing Myr-I3-01-myc-p6, I3-01, and EPNs 01-48.

| Construct | Enzyme activity | Conclusion |
| --- | --- | --- |
| EPN-44 | Detergent-dependent | Released from cells as an EPN |
| EPN-45 | None | Not released from cells |
| EPN-46 | Detergent-dependent | Released from cells as an EPN |
| EPN-47 | Detergent-dependent | Released from cells as an EPN |
| EPN-48 | Detergent-dependent | Released from cells as an EPN |

BlaM Protein Delivery Assay

The ability of the EPNs to package and deliver a protein cargo to the cytoplasm of recipient cells was evaluated using a modified version of the beta-lactamase (BlaM) delivery assay originally developed by Cavrois et al. to measure the membrane fusion event effected by the HIV envelope protein (Cavrois M, de Naronha C, Greene W C (2002), Nat. Biotech. 20:1151-4). In the original version of the assay, a chimeric protein in which BlaM is fused to the HIV Vpr protein (SEQ ID 203; BlaM-Vpr) is co-expressed with DNA encoding HIV virions or virus-like particles in mammalian cells. A non-covalent, protein-protein interaction between Vpr and the p6 domain of the HIV Gag protein results in incorporation of the BlaM-Vpr fusion protein in enveloped virions or virus-like particles that bud and are released from the cell surface. The BlaM-Vpr-containing enveloped virions or virus-like particles can then be added to recipient cells, upon which the envelope protein binds to its target receptor, facilitating cellular uptake and fusion of the viral or VLP membrane with cellular membranes, thereby releasing the virion with its BlaM-Vpr cargo into the cytosol. The recipient cells are treated with the fluorescent dye CCF2-AM, which contains two fluorophores that make an efficient FRET pair connected by a beta-lactam ring. If BlaM (or, in this case, BlaM-Vpr) is present in the cytosol of the cells, it will cleave the CCF2-AM substrate, resulting in a change of the fluorescence emission maximum from 520 nm to 447 nm. This change in the fluorescence signal can be detected using a variety of instruments capable of detecting fluorescent signals, including but not limited to spectrophotometers, fluorimeters, plate readers, and flow cytometers.

In our modified version of the BlaM delivery assay, enveloped Myr-I3-01-myc-p6 or EPN-01 multimeric assemblies replaced the HIV virions or virus-like particles in packaging and facilitating the entry of BlaM-Vpr into the recipient cells. Although a wide variety of potential packaging moieties could be used to package BlaM into EPNs, the p6 domain of Myr-I3-01-myc-p6 (SEQ ID 186) in combination with the Vpr domain of the BlaM-Vpr fusion protein (SEQ ID 203) served as a convenient and effective packaging moiety. In other embodiments, other polypeptide sequences known to interact with a cargo of interest could be used to package the cargo. In other embodiments, packaging moieties selected from the set disclosed herein and in the attached appendices could be used to package a cargo of interest. In addition, because the Myr-I3-01-myc-p6 polypeptide does not comprise a polypeptide domain capable of facilitating cell entry and membrane fusion, we pseudotyped the EPNs with a viral fusion protein by co-expression in the producer cells. A wide variety of viral fusion proteins could be used to facilitate cell entry and membrane fusion. In one embodiment, the glycoprotein from vesicular stomatitis virus (VSV-G) was incorporated into the membrane envelope of Myr-I3-01-myc-p6 EPNs. In other embodiments, a protein selected from the set of known viral envelope proteins and sequences disclosed herein and in the attached appendices could be used to facilitate cell entry and membrane fusion.

Myr-I3-01-myc-p6 EPNs packaging the BlaM-Vpr fusion protein and pseudotyped with VSV-G were produced by co-transfecting HEK293T cells ($5 \times 10^6$ cells in a 10 cm dish seeded 24 h prior to transfection) with 9 µg of pCMV-Myr-I3-01-myc-p6 DNA, 5 µg of myc-BlaM-Vpr expression construct (derived from pMM310) (Cavrois M, de Naronha C, Greene W C (2002), Nat. Biotech. 20:1151-4; Tobiume, M., et al., J Virol, 2003. 77(19): p. 10645-50), and 1 µg VSV-G-myc expression construct (derived from pCMV-VSV-G) (Yee, J. K., T. Friedmann, and J. C. Burns, Methods in cell biology, 1994. 43 Pt A: p. 99-112; Olsen, J. C., Gene transfer vectors derived from equine infectious anemia virus. Gene Ther, 1998. 5(11): p. 1481-7) using LIPO-FECTAMINE® 2000 (Invitrogen). EPNs were harvested by centrifugation though a 20% sucrose cushion (24,000 rpm in a SW41Ti rotor [BeckmanCoulter], 2 h, 4° C.) 24-36 h post transfection. The amounts of the Myr-I3-01-myc-p6, BlaM-Vpr, and VSV-G proteins incorporated into the EPNs were quantified by Western blotting.

For the BlaM delivery assay, either $2 \times 10^4$ cells/well were seeded in a 96 well plate or $1 \times 10^5$ cells were seeded in a 24 well plate. 24 h later, a serial dilution of standardized quantities of enveloped nanoparticles were added to the cells and incubated for 2 h at 37° C. and 5% $CO_2$. After two hours, EPN-containing supernatants were replaced by CCF2-AM-labelling media prepared according to the manufacturer's instructions (Invitrogen). Cells were labeled for 16 h at 13° C. and assayed for a change in fluorescence emission spectrum from green (520 nm) to blue (447 nm) by flow cytometry (FACSCanto, BD Biosciences).

The BlaM delivery assay was performed using Myr-I3-01-myc-p6 EPNs packaging BlaM-Vpr and pseudotyped with VSV-G. The incorporation of Myr-I3-01-myc-p6, BlaM-Vpr, and VSV-G in the EPNs was confirmed by Western blotting. Replacing Myr-I3-01-myc-p6 with I3-01, which lacks the membrane interaction and ESCRT recruitment domains required for budding and release as an EPN, resulted in no VSV-G or BlaM-Vpr in the pelleted culture supernatants. Recipient cells treated with increasing amounts of Myr-I3-01-myc-p6 EPNs packaging BlaM-Vpr and pseudotyped with VSV-G showed a dose-dependent increase in the number of BlaM-positive cells. In contrast, significant numbers of BlaM-positive cells were not observed for EPNs that were either: 1) pseudotyped with a mutant VSV-G incapable of membrane fusion [VSV-G (P127D) (SEQ ID NO: 307)] or lacked significant levels of packaged BlaM-Vpr owing to the use of a Myr-I3-01-myc-p6 mutant that disrupted the non-covalent interface between p6 and Vpr [Myr-I3-01-myc-p6($LF_{45}AA$) (SEQ ID NO: 318)]. Together, these results demonstrate that Myr-I3-01- myc-p6 EPNs that packaged BlaM-Vpr and were pseudotyped with VSV-G delivered the BlaM-Vpr protein to the cytoplasm of the recipient cells via VSV-G-mediated membrane fusion.

(Myr-I3-01-myc-p6(LF$_{45}$AA))
SEQ ID 318
(M)GARASGSKSGSGSDSGSKMEELFKKHKIVAVLRANSVEEAKKKAL

AVFLGGVHLIEITFTVPDADTVIKELSFLKEMGAIIGAGTVTSVEQCR

KAVESGAEFIVSPHLDEEISQFCKEKGVFYMPGVMTPTELVKAMKLGH

TILKLFPGEVVGPQFVKAMKGPFPNVKFVPTGGVNLDNVCEWFKAGVL

AVGVGSALVKGTPVEVAEKAKAFVEKIRGCTE(QKLISEEDL)QSRPE

PTAPPEESFRSGVETTTPPQKQEPIDKELYPLTSLRSAAGNDPSSQ

Packaging mRNA Cargoes into Enveloped Protein Nanocages

We designed and evaluated a series of constructs intended to package messenger RNA (mRNA) cargoes within the membrane envelope of the enveloped protein nanocages of the disclosure. For each of the four mRNA packaging moieties disclosed herein (SEQ IDs 198, 199, 200, 201), four constructs were made—direct genetic fusions to either EPN-01-posT1 (SEQ ID 229) or EPN-01 (SEQ ID 230), and a "frameshift" variant of each fusion in which the packaging domain is expected to be included in only a fraction of the protein molecules produced owing to the presence of a frameshift element in the gene (SEQ IDs 254, 255, 256, 257, 258, 259, 260, 261, 262, 263, 264, 265, 266, 267, 268, 269). The frameshift element, located in the linker between EPN-01 and the packaging domain, was derived from HIV Gag-Pol and causes the ribosome to undergo a −1 frameshift during roughly 5-10% of its encounters with the frameshift element during mRNA translation (Biswas P, Jiang X, Pacchia A L, Dougherty J P, Peltz S W (2004), J. Virol. 78:2082-7). The frameshift sequences were designed such that a successful frameshift would result in translation of the RNA packaging moiety, so that 5-10% of the protein subunits would be expected to comprise the packaging moiety as a genetic fusion. The four packaging moieties tested were all polypeptide motifs or domains that have been shown to bind preferentially to a specific RNA recognition sequence (SEQ IDs 204, 205, 206, 207; Gosser Y, Hermann T, Majumdar A, Hu W, Frederick R, Jiang F, Xu W, Patel D J (2001), Nat. Struct. Biol. 8:146-50; Oubridge C, Ito N, Evans P R, Teo C H, Nagai K (1994), Nature 372:432-8; De Guzman R N, Wu Z R, Stalling C C, Pappalardo L, Borer P N, Summers M F (1998), Science 279:384-8; Puglisi J D, Chen L, Blanchard S, Frankel A D (1995), Science 270: 1200-3). We also designed expression plasmids encoding mRNA cargo molecules (SEQ IDs 208, 209, 210, 211, 212, 213, 214, 215, 216, 217, 218, 219) that contained the corresponding recognition sequences both upstream (5') and downstream (3') of a reporter construct [either beta lactamase (BlaM) or GFP]. Upon co-expression of a multimeric assembly bearing a packaging moiety and the mRNA cargo bearing the cognate recognition sequence, the interaction between the packaging moiety and the recognition sequence should recruit the mRNA cargo to the multimeric assembly, resulting in its packaging within the membrane envelope of the enveloped protein nanocage. We used reverse transcription quantitative polymerase chain reaction (RT-qPCR) to detect and determine relative concentrations of packaged mRNA cargoes.

Plasmids encoding the packaging moiety-bearing proteins and the mRNA cargoes were co-transfected into 1.25×10$^8$ HEK293F cells using EXPIFECTAMINE® (Invitrogen) according to the manufacturer's instructions. 40 hours after transfection, cells were pelleted by centrifugation at 1500×g for 5 min, and enveloped protein nanocages were purified from the supernatant by filtration through a 0.45 µm filter and pelleting through a 20% sucrose cushion as described above. The enveloped protein nanocages were resuspended in phosphate buffered saline (PBS). In some experiments, the enveloped protein nanocages were treated with RNase A, Triton X-100, or both prior to detection of packaged mRNA by RT-qPCR. Relative RNA levels were analyzed by RT-qPCR as follows. RNA was extracted from enveloped protein nanocages by mixing 100 µL of enveloped protein nanocages with 500 µL Trizol and freezing overnight. The next day, 100 µL of chloroform was added to the thawed sample and the tube was shaken vigorously before centrifugation at 20,000×g for 10 minutes at 4° C. Next, 200 µL of aqueous phase was mixed with 200 µL of 100% ethanol and purified using a Qiagen RNEASY® kit according to the manufacturer's protocols. The purified RNA was eluted in 45 µL distilled water (dH$_2$O) and treated with 5 µL of 10× Turbo DNase buffer and 1 µL of Turbo DNase at 37° C. for 20 minutes. DNase was then removed by purifying the RNA with Ampure RNAclean XP beads according to the manufacturer's protocols and eluting in 30 µL dH$_2$O. A reverse transcription primer compatible with all mRNA cargoes tested (CATACTGTTGGTTGCTAGGC (SEQ ID NO: 319)) was annealed to the purified RNA by incubation of the following reaction at 65° C. for 5 minutes: 2 µL RNA, 1 µL reverse transcription primer (unless otherwise noted, all primer stock concentrations were 10 µM), 6 µL dH$_2$O, 0.5 µL 0.1 M DTT, and 0.5 µL SUPERase-In RNase Inhibitor. For the detection of mitochondrial RNA, the reverse transcription primer was substituted with primers specific to cytochrome c oxidase subunit I (GCTGTGACGATAACGTTGTAGATG (SEQ ID NO: 320)) or cytochrome c oxidase subunit II (GGACGATGGGCATGAAACTG (SEQ ID NO: 321)). Reverse transcription was performed with the following reaction using a THERMOSCRIPT® Reverse Transcriptase kit (ThermoFisher Scientific): 5 µL of hybridization reaction, 2 µL cDNA synthesis buffer, 0.5 µL 0.1 M DTT, 0.5 µL SUPERASE®-In RNase Inhibitor, 1 µL 10 mM dNTPs, and 1 µL THERMOSCRIPT® Reverse Transcriptase. Negative controls were also performed in which the reverse transcriptase was replaced with dH$_2$O. The reverse transcription reaction was performed at 52° C. for 1 hour followed by heat inactivation at 80° C. for 5 minutes. The crude cDNA was then used as template in a qPCR reaction: 5 µL 2× Kapa HIFI HOTSTART® READY MIX®, 0.5 µL SYBR green, 0.5 µL forward primer TAGGATTACTGCTCGGTGAC (SEQ ID NO: 322), 0.5 µL reverse primer CCAAATAGGATGTGTGCGAC (SEQ ID NO: 323), 2.5 µL dH2O, and 1 µL cDNA. For amplification of mitochondrial cDNAs, the primers were substituted with primers specific to cytochrome c oxidase subunit I (forward: CCACAAAGACATTGGAACACTATACC (SEQ ID NO: 324); reverse: GCTGTGACGATAACGTTGTAGATG (SEQ ID NO: 325)) or cytochrome c oxidase subunit II (forward: CCTTATCTGCTTCCTAGTCCTGTATG (SEQ ID NO: 326); reverse: GGACGATGGGCATGAAACTG (SEQ ID NO: 327)). The thermocycler program was 3 minutes at 95° C. followed by 29 cycles of 20 seconds at 98° C., 15 seconds at 64° C., 90 seconds at 72° C., and the SYBR® green signal was then read.

Analysis of enveloped protein nanocages bearing the nucleic acid packaging domains described herein by RT-qPCR revealed the presence of packaged mRNA cargoes within the membrane envelopes of the enveloped protein nanocages. The enveloped protein nanocages based on EPN-01 in which the packaging moieties were included in 5-10% of the protein subunits due to the frameshift element yielded lower levels of mRNA cargo incorporation than those in which the packaging moiety was fused directly to EPN-01, suggesting that higher numbers of packaging moieties assist in the packaging of more mRNA cargoes. In contrast, the direct fusion and the frameshift constructs based on EPN-01-posT1 yielded similarly high levels of mRNA cargo incorporation, suggesting that the high number of positively charged residues on the interiors of the multimeric assemblies was able to drive packaging of the mRNA cargoes irrespective of the number of copies of the packaging moiety.

Experiments in which the enveloped protein nanocages were challenged with detergent, RNase A, or both prior to analysis by RT-qPCR demonstrated that the packaged mRNA is contained within the membrane envelope of the enveloped protein nanocages. These experiments were similar to the protease and enzyme activity assays described above in that they evaluated the accessibility of the mRNA cargoes to RNase A in the presence and absence of detergent. A mixture of four pooled mRNA-packaging enveloped protein nanocages [produced from four different co-transfections with plasmids encoding the four EPN-01-posT1 constructs (SEQ IDs 256, 260, 264, and 268) and corresponding mRNA cargoes (SEQ IDs 208, 209, 210, and 211)] yielded similar levels of mRNA cargoes after incubation in PBS for 10 minutes (no treatment), incubation with 20 μg/mL RNase A for 10 minutes, or incubation with 1% Triton X-100 for 10 minutes prior to RT-qPCR. In contrast, the level of packaged mRNA cargo was depleted by more than three orders of magnitude when the same mixture of mRNA-packaging enveloped protein nanocages was incubated with 20 μg/mL RNase A and 1% Triton X-100 for 10 minutes prior to RT-qPCR. This detergent-dependent degradation of the mRNA cargoes by RNase demonstrated that the membrane envelope of the enveloped multimeric nanoparticles provides an effective barrier that protects the packaged mRNA cargoes from degradation. In other experiments, we have observed no degradation of packaged mRNA cargoes when the RNase incubation is extended to 16 hours (in the absence of detergent).

Control experiments in which we analyzed enveloped protein nanocages for the presence of mitochondrial RNAs demonstrated that they are free of cellular (or mitochondrial) contamination. Mitochondrial mRNAs encoding cytochrome c oxidase subunits I and II were readily detected by RT-qPCR of the cell pellets of cells expressing the enveloped multimeric particles. In contrast, the same mRNAs were not detectable in the purified enveloped protein nanocages. This result demonstrates that the packaged and protected mRNA cargoes we observed in the experiments described above were not present inside cells contaminating the enveloped protein nanocages, but were in fact packaged within the membrane envelopes of the enveloped protein nanocages.

We further analyzed the interactions between the packaging moieties and their cognate recognition sequences by performing an all-against-all comparison. Each of the four constructs in which the packaging domains disclosed herein were fused to EPN-01-posT1 (SEQ IDs 256, 260, 264, and 268) was co-transfected with plasmids encoding the four different versions of an mRNA cargo comprising the four recognition sequences disclosed herein (SEQ IDs 208, 209, 210, and 211) for a total of 16 co-transfections. The yield of packaged mRNA cargo from each resulting enveloped protein nanocage was assessed by RT-qPCR as described above. While all four RNA binding domains showed the highest packaging yield for the mRNA cargoes bearing their cognate recognition sequences, the 1g70 and 1mnb RNA packaging moieties exhibited the highest specificity.

Packaging Cytoplasmic Cargoes in Enveloped Protein Nanocages

Recently, it was shown that enveloped viruses such as HIV and influenza can package small organic molecules—specifically, 2',3'-cyclic GMP-AMP (cGAMP)—from the host cell cytoplasm, and that the packaged cGAMP is capable of inducing the type I interferon response in the cells they go on to infect (Gentili M, et al. (2015), Science 349:1232-6; Bridgeman A, et al. (2015), Science 349:1228-32). cGAMP is a second messenger synthesized by the cytosolic DNA-sensing protein cyclic GMP-AMP synthase (cGAS) as part of the recently discovered cGAS-STING innate immune pathway that activates the type I interferon response (Sun L, Wu J, Du F, Chen X, Chen Z J (2013), Science 339:786-91; Wu J, Sun L, Chen X, Du F, Shi H, Chen C, Chen Z J (2013), Science 339:826-30). In the non-limiting embodiments described below, the inventors have shown that cGAMP can be packaged within the lumen of the membrane envelope of the enveloped protein nanocages of the disclosure and, if the enveloped protein nanocages also comprise a protein capable of mediating membrane fusion, the packaged cGAMP can be delivered to the cytoplasm of recipient cells, where it induces a functional interferon response by binding to and activating STING. From these data, those of skill in the art will recognize the ability of the enveloped protein nanocages of the disclosure to package other types of molecules, such as proteins, nucleic acids, lipids, or other small organic molecules, from the cytoplasm of the cell in which they are produced.

cGAMP-loaded enveloped protein nanocages were prepared by transfecting ~2.5×10$^6$ HEK293T cells in a 10-cm tissue culture dish with 6 μg of plasmid encoding either EPN-01-posT1 or Myr-I3-01-myc-p6, 10 μg plasmid encoding human cGAS, and 1.5 μg plasmid encoding either VSV-G or the ecotropic envelope protein of Murine Moloney Leukemia Virus (Eco). Control transfections were also performed in which one or more of the plasmids was omitted. HEK293T cells are known to not express cGAS; therefore, cGAMP production requires expression of recombinant cGAS. HEK293T cell culture supernatants were harvested 36-48 hours after transfection and filtered through a 0.45 μm filter. In some experiments, enveloped protein nanocages were pelleted by centrifugation through a 20% sucrose cushion at 70,000×g, resuspended in 100 μl PBS, and diluted in complete media (DMEM supplemented with 10% fetal bovine serum). In the experiments described below, the filtered supernatants were used directly to administer the enveloped protein nanocages to macrophages. The ability of the enveloped protein nanocages to package and deliver cGAMP was evaluated using a macrophage stimulation assay as follows. Primary murine bone marrow-derived macrophages were cultured from the following mice: C57BL6/J (wild-type), cGAS$^{-/-}$ (Mb21d$^{-/-}$ Gray E E, Trueting P M, Woodward J J, Stetson D B (2015), J. Immunol. 195:1939-43), or Tmem173$^{-/-}$ (STING-deficient; Ishikawa H, Barber G N (2008), Nature 455:674-8). Macrophages were incubated with cGAMP-loaded or control enveloped protein nanocages for 6-8 hours. Type I interferons in culture supernatants from stimulated macrophages were quantified using an interferon bioassay in which L929 cells expressing an interferon-stimulated response element (ISRE)-luciferase reporter were incubated with macrophage culture supernatants for 6 hours. L929-ISRE reporter cells were lysed and luciferase activity was quantified using a Luciferase Assay System (Promega) and Centro LB 960 Microplate Luminometer (Berthold Technologies). In this assay, luciferase activity is correlated with the concentration of interferons in the macrophage supernatants, which is in turn proportional to the amount of bioactive cGAMP delivered to the macrophage cytoplasm by the enveloped protein nanocages.

In a first set of experiments, we used VSV-G as the envelope protein that mediates fusion of the enveloped protein nanocage membrane with recipient cell memnbranes. Enveloped protein nanocages prepared from HEK293T cells expressing EPN-01-posT1, cGAS, and VSV-G induced interferon production in wild-type macrophages roughly equivalent to that of transfected calf thymus DNA, a commonly used positive control for measuring cGAS- and STING-dependent innate immune responses. The same enveloped protein nanocages also induced a strong interferon response in cGAS-deficient macrophages, suggesting that the stimulus associated with the enveloped protein nanocages responsible for inducing interferon production was not DNA. In contrast, interferon production was reduced to background levels in STING-deficient macrophages. The cGAS-independent, STING-dependent nature of the response strongly suggests that the enveloped protein nanocage-associated stimulus was cGAMP, the known activating ligand of STING. Additional controls confirmed this suggestion: enveloped protein nanocages produced in cells that did not express cGAS, VSV-G, or both failed to induce interferon production in any macrophages. Together, these data show that the stimulus for interferon production was dependent on expression of cGAS and dependent on the presence of a protein capable of mediating membrane fusion. Interestingly, filtered supernatants from cells expressing cGAS and VSV-G, but not EPN-01-posT1, induced interferon production in wild-type and cGAS-deficient cells but not STING-deficient cells in a manner closely resembling the behavior of enveloped protein nanocages produced in cells expressing all three proteins. Given the known ability of VSV-G to induce the formation of extracellular vesicles on its own (Mangeot P, Dollet S, Girard M, Ciancia C, Joly S, Peschanski M, Lotteau V (2011) Protein transfer into human cells by VSV-G-induced nanovesicles. Mol. Therapy 19:1656-66), we hypothesized that VSV-G-induced extracellular vesicles were packaging and delivering cGAMP in a manner similar to the enveloped protein nanocages. We therefore evaluated the ability of an alternative envelope protein, that of the Moloney Murine Leukemia Virus (Eco), which is not known to induce extracellular vesicle formation upon expression in human cells, to mediate cytoplasmic delivery of packaged cGAMP. Enveloped protein nanocages prepared from HEK293T cells expressing Myr-I3-01-myc-p6, cGAS, and Eco induced an interferon response in wild-type macrophages, while those prepared from HEK293T cells expressing cGAS and Eco with I3-01, which we have shown does not produce enveloped protein nanocages (see above), did not induce interferon production. This experiment demonstrated that in the absence of background vesicles derived from VSV-G-induced vesicle formation, a functional enveloped protein nanocage protein was required in order to mediate the packaging and delivery of cGAMP to recipient cells via the enveloped protein nanocages of the disclosure. Taken together, the results of the macrophage stimulation assays described here demonstrate that the enveloped protein nanocages of the disclosure package cGAMP and deliver it to the cytoplasm of the recipient cells, where it stimulates a functional interferon response. The lack of any known interactions between cGAMP and the protein subunits of the enveloped protein nanocage, in combination with similar packaging and delivery of cGAMP by both enveloped viruses and VSV-G-derived extracellular vesicles (described above), establishes that packaging of cGAMP inside the membrane envelope of the enveloped protein nanocages is the result of the packaging of a volume of host cell cytoplasm which contains cGAMP rather than specific recruitment of cGAMP to the enveloped protein nanocages by a packaging moiety. As will be known to those of skill in the art, this property of the enveloped protein nanocages enables the packaging of a variety of molecules present in the host cell cytoplasm, including but not limited to proteins, nucleic acids, lipids, and other small organic molecules.

(human cGAS)
SEQ ID 328
ME(QKLISEEDL)QPWHGKAMQRASEAGATAPKASARNARGAPMDPTE

SPAAPEAALPKAGKFGPARKSGSRQKKSAPDTQERPPVRATGARAKKA

PQRAQDTQPSDATSAPGAEGLEPPAAREPALSRAGSCRQRGARCSTKP

RPPPGPWDVPSPGLPVSAPILVRRDAAPGASKLRAVLEKLKLSRDDIS

TAAGMVKGVVDHLLLRLKCDSAFRGVGLLNTGSYYEHVKISAPNEFDV

MFKLEVPRIQLEEYSNTRAYYFVKFKRNPKENPLSQFLEGEILSASKM

LSKFRKIIKEEINDIKDTDVIMKRKRGGSPAVTLLISEKISVDITLAL

ESKSSWPASTQEGLRIQNWLSAKVRKQLRLKPFYLVPKHAKEGNGFQE

ETWRLSFSHIEKEILNNHGKSKTCCENKEEKCCRKDCLKLMKYLLEQL

KERFKDKKHLDKFSSYHVKTAFFHVCTQNPQDSQWDRKDLGLCFDNCV

TYFLQCLRTEKLENYFIPEFNLFSSNLIDKRSKEFLTKQIEYERNNEF

PVFDEF (Ecotropic envelope protein from Moloney Murine Leukemia Virus or "Eco")
SEQ ID 308
MARSTLSKPLKNKVNPRGPLIPLILLMLRGVSTASPGSSPHQVYNITW

EVTNGDRETVWATSGNHPLWTWWPDLTPDLCMLAHHGPSYWGLEYQSP

FSSPPGPPCCSGGSSPGCSRDCEEPLTSLTPRCNTAWNRLKLDQTTHK

SNEGFYVCPGPHRPRESKSCGGPDSFYCAYWGCETTGRAYWKPSSSWD

FITVNNNLTSDQAVQVCKDNKWCNPLVIRFTDAGRRVTSWTTGHYWGL

RLYVSGQDPGLTFGIRLRYQNLGPRVPIGPNPVLADQQPLSKPKPVKS

PSVTKPPSGTPLSPTQLPPAGTENRLLNLVDGAYQALNLTSPDKTQEC

WLCLVAGPPYYEGVAVLGTYSNHTSAPANCSVASQHKLTLSEVTGQGL

CIGAVPKTHQALCNTTQTSSRGSYYLVAPTGTMWACSTGLTPCISTTI

LNLTTDYCVLVELWPRVTYHSPSYVYGLFERSNRHKREPVSLTLALLL

GGLTMGGIAAGIGTGTTALMATQQFQQLQAAVQDDLREVEKSISNLEK

SLTSLSEVVLQNRRGLDLLFLKEGGLCAALKEECCFYADHTGLVRDSM

-continued

AKLRERLNQRQKLFESTQGWFEGLFNRSPWFTTLISTIMGPLIVLLMI

LLFGPCILNRLVQFVKDRISVVQALVLTQQYHQLKPIEYEP

Example 2

Abstract

Figure 1:
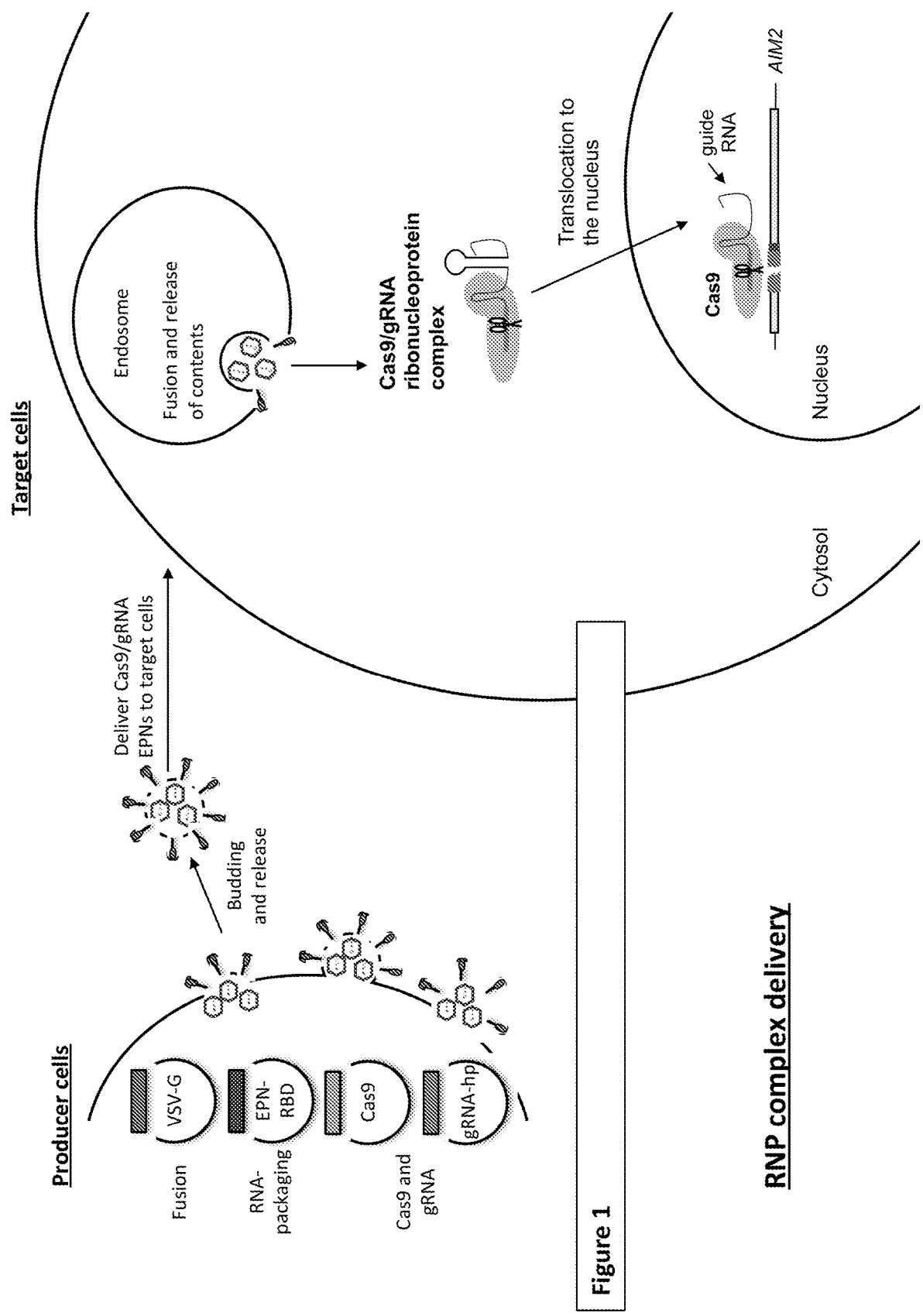
FIG. 1: Schematic of Cas9/gRNA EPN delivery of Cas9 ribonucleoprotein complexes. Cas9/gRNA EPNs are purified from the supernatants of producer cells expressing a fusion protein, RNA-packaging EPN protein subunits, and Cas9/gRNA ribonucleoprotein (RNP) complexes that are packaged into the EPNs by RNA sequences (e.g. hairpins, hp) that bind to the EPN protein subunit RNA-binding domain (RBD). Cas9/gRNA EPNs are delivered to recipient cells, and contents are released into the cytosol following endosomal fusion. The Cas9/gRNA RNP complexes then translocate to the nucleus for AIM2 gene editing.
Figure 2:
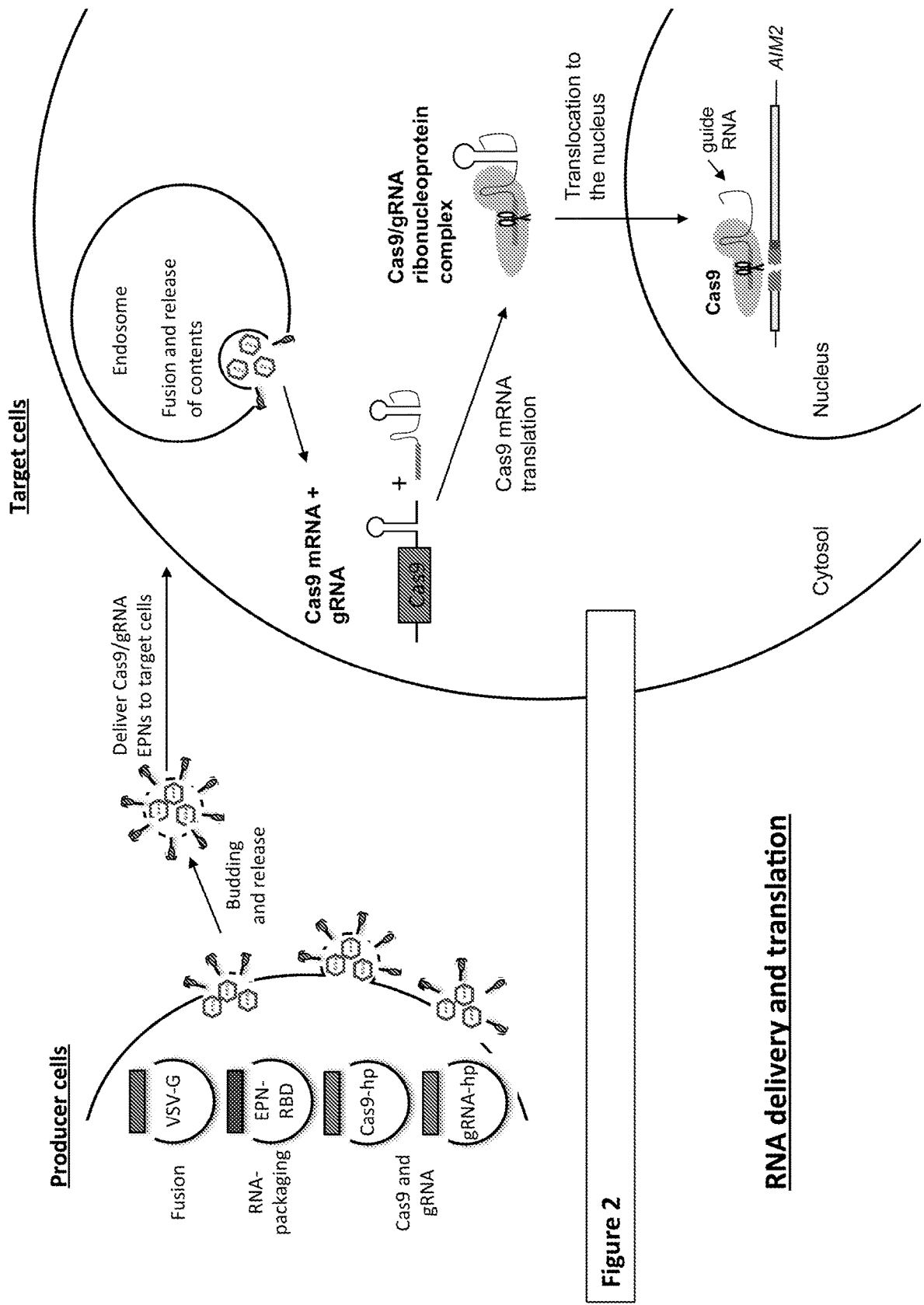
FIG. 2: Schematic of Cas9/gRNA EPN delivery of Cas9 mRNA and gRNA. Cas9/gRNA EPNs are purified from the supernatants of producer cells expressing a fusion protein, RNA-packaging EPN protein subunits, and Cas9 mRNA and gRNA that are packaged into the EPNs by RNA sequences (e.g. hairpins, hp) that bind to the EPN protein subunit RNA-binding domain (RBD). Cas9/gRNA EPNs are delivered to recipient cells, and contents are released into the cytosol following endosomal fusion. Cas9 mRNA is translated and gRNA is loaded onto the translated Cas9 protein. The Cas9/gRNA RNP complexes then translocate to the nucleus for AIM2 gene editing.

CRISPR/Cas9 gene editing requires two essential components: the Cas9 endonuclease and a guide RNA (gRNA) that directs Cas9-mediated DNA cleavage to a 20 base pair (bp) target sequence in the genome. The term guide RNA (gRNA) is used to refer to any DNA-targeting RNA molecule that guides the genome editing protein to a specific sequence in the genome. gRNA refers to all RNAs that guide Cas protein (e.g., Cas9) targeting, including tracrRNA, crRNAs, and single guide RNAs (sgRNAs). We have developed a method to encapsulate and deliver Class 2 Cas proteins (such as Cas9) and gRNA to recipient cells using enveloped protein nanocages (EPNs), which are non-viral assemblies that direct their own release from mammalian cells inside small vesicles and then deliver their contents into recipient cells. Genome editing can be achieved by delivering ribonucleoprotein complexes (FIG. 1) or RNA capable of being translated to produce ribonucleoprotein complexes (FIG. 2).

Figure 3:
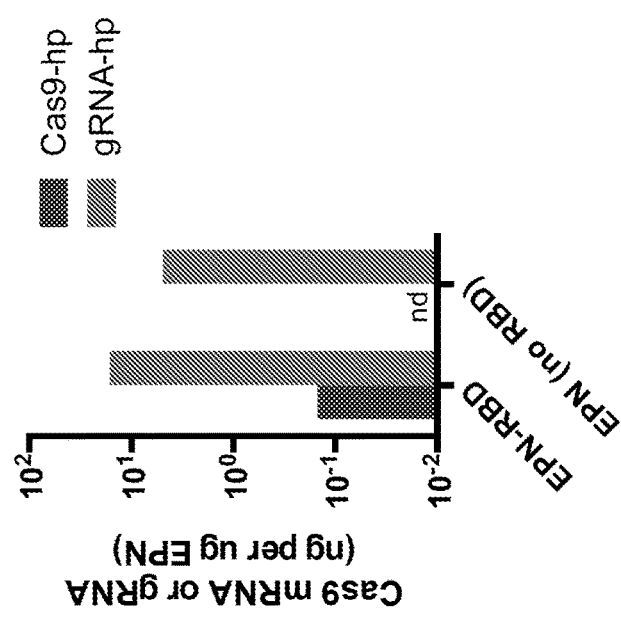
FIG. 3: Detection of Cas9 mRNA and gRNA in EPNs by qRT-PCR. Quantification by RT-PCR of Cas9 mRNA and gRNA in EPNs harvested from producer cells expressing a fusion protein [VSVg], Cas9-hp [FLAG-Cas9-1g70-WPRE], gRNA-hp [gRNA-1g70], and EPN-11-RBD [EPN-11-1g70] or EPN-11 (no RBD).

One embodiment of the method involves co-expression in producer cells of:
(i) RNA-binding domains (RBDs) genetically fused to non-viral enveloped protein nanocage (EPN) protein subunits that self-assemble and are released from producer cells inside cell-derived membrane envelopes via membrane binding and ESCRT-mediated membrane scission.
(ii) Cas9 mRNA and gRNA containing RNA sequences that can be bound by the RBDs and packaged into the EPN (FIG. 3).
(iii) A fusion protein (e.g., VSV-G) that releases EPN contents into the cytosol of the recipient cell via fusion of the EPN membrane with the recipient cell membrane.

Figure 4:
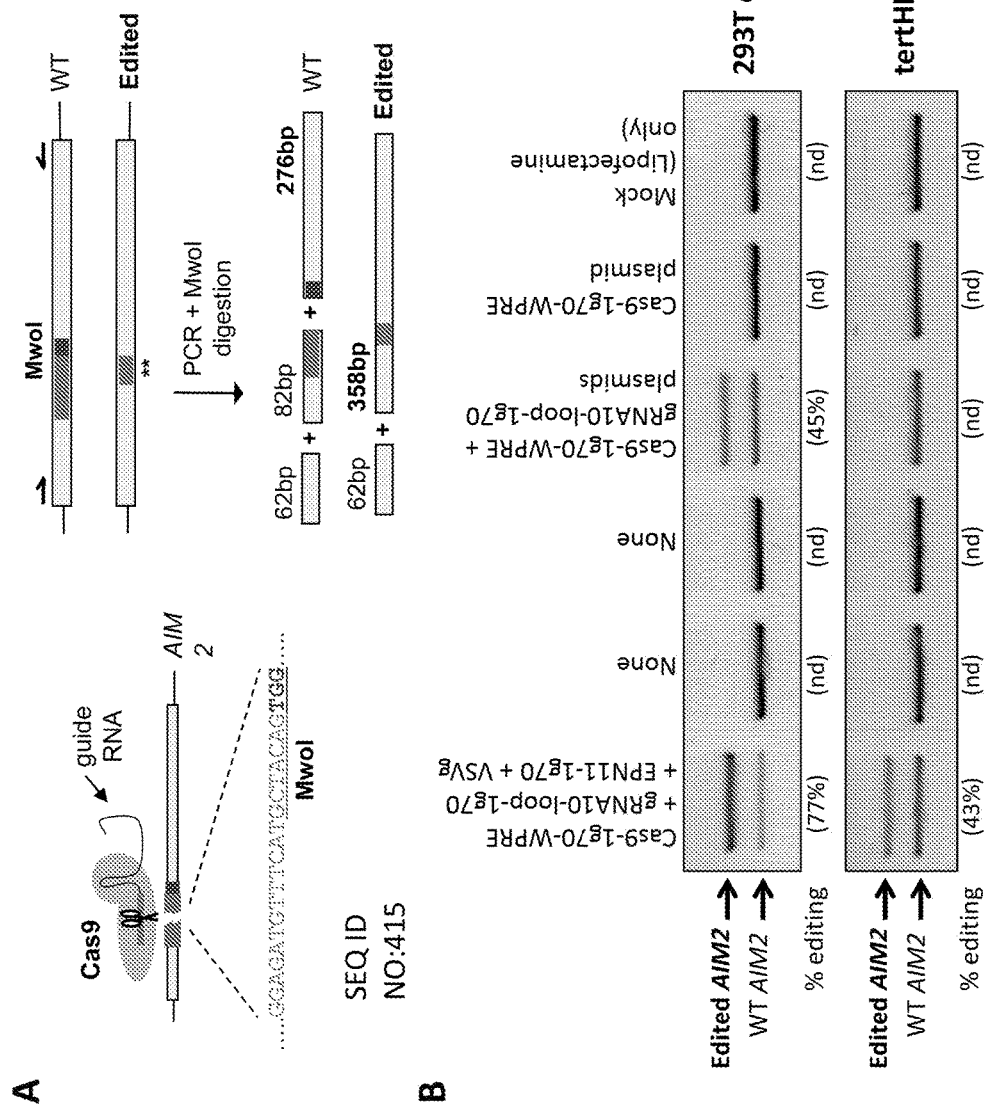
FIG. 4: Delivery of Cas9/gRNA EPNs to mammalian cells results AIM2 gene editing. (A) Schematic of restriction digest assay was used to estimate AIM2 gene editing. (B) Analysis of AIM2 gene editing (% of edited alleles) 3 days after delivery of 25 µg Cas9/gRNA EPNs (far left lane) or transfection (using lipofectamine) of Cas9 and gRNA expression plasmids (right lanes, as indicated) to 50,000 293T cells (top panel) or telomerase-immortalized human fibroblast (tertHF) cells (bottom panel).

EPNs may be purified from producer cell cultures by, for example, ultracentifugation over a 20% sucrose cushion. EPNs are then incubated with recipient cells for delivery of Cas9 and gRNA, leading to gene editing directed by the gRNA sequence (FIG. 4).

Methods

Cell Lines

Expi293F (293F) cells were obtained from ThermoFisher Scientific and cultured in Expi293™ Expression Medium (ThermoFisher Scientific) containing penicillin (100 U/mL) and streptomycin (0.1 mg/mL), at 37° C. and 8% C02 while shaking at 125 r.p.m. HEK293T (293T) cells, primary human fibroblasts (HF) and telomerase-immortalized HF (tertHF; kindly provided by Denise Galloway, Fred Hutchinson Cancer Research Center) were grown in DMEM supplemented with 10% fetal calf serum, L-glutamine (2 mM), penicillin (100 U/mL), streptomycin (0.1 mg/mL), sodium pyruvate (1 mM), HEPES (10 mM), and β-mercaptoethanol (50 uM). THP-1 cells were cultured in RPMI supplemented as above.

EPN Production

Prior to transfection, 25 mL of Expi293F cells ($2.5 \times 10^6$ cells/mL) were transferred into a 125 mL baffled shaker flask. A total of 25 µg of plasmid DNA (plasmid ratios=nanocage:fusion protein:Cas9:gRNA=10:1.5:3:5) was transfected into Expi293F cells using Expifectamine transfection reagent (ThermoFisher Scientific) according to the manufacturer's instructions. Expression was performed at 37° C. and 8% C02 while shaking at 125 r.p.m. Cells and supernatants were harvested after 38 hours of expression. Cells were removed by centrifugation at 1,000 rcf, 4° C. for 5 minutes. The supernatant was filtered through a 0.45 µm filter (ENID Millipore) into ultracentrifuge tubes. Subsequently, 5 mL of 20% sucrose dissolved in phosphate buffered saline (PBS) was layered underneath the filtrate. The tubes were balanced with PBS, and then the samples were ultracentrifuged at 70,000 rcf, 4° C. for 2 hours. The supernatant was aspirated, and the EPN pellet was resuspended in PBS or DMEM without any supplements.

Quantification of Cas9 mRNA and gRNA in Producer Cells and EPNs (qRT-PCR).

For quantitative RT-PCR analysis, cells were harvested into TRIzol (Thermo Fisher Scientific) or RNA Stat-60 (Tel-Test, INC). RNA was isolated using a Direct-zol RNA Miniprep Plus kit (Zymo Research) per manufacturer's instructions and treated with Turbo DNase (Thermo Fisher Scientific) per manufacturer's instructions. RNA was reverse-transcribed into cDNA with PrimeScript Reverse Transcriptase (Clontech) as follows: RNA was annealed with 50 pmol random primer mix (NEB, #S1330S) and 2 pmol of a gRNA-specific primer (RT gRNA Rev: ACTCGGTGCCACTTTTTCAAG; SEQ ID NO:388) by incubating at 70° C. for 10 minutes, then 4° C. for at least 30 seconds. The annealed RNA/primer mix was combined with Primescript buffer (1× final concentration), 500 uM dNTPs, 4 units SUPERase-In RNase Inhibitor (Thermo Fisher Scientific), and 200 units PrimeScript Reverse Transcriptase (Clontech). Reverse transcription was carried out by incubating at 50° C. for 1 hour, then 70° C. for 15 minutes. Quantitative PCR was performed with iTaq Universal SYBR Green Supermix (Bio-Rad Laboratories) per manufacturer's instructions using primers and cycling conditions listed below on a Bio-Rad CFX96 Real-Time System.

Primers:

AIM2 (AIM2) gRNA:
AIM2 gRNA Fwd:
(SEQ ID NO: 389)
GGAGATGTTTCATGCTACAGGTT gRNA common Rev:
(SEQ ID NO: 390)
TTCAAGTTGATAACGGACTAGCC CD18 (ITGB2) gRNA:
CD18 gRNA Fwd:
(SEQ ID NO: 391)
GTGACGCTTTACCTGCGACCG gRNA common Rev:
(SEQ ID NO: 392)
TTCAAGTTGATAACGGACTAGCC PD-1 (Pdcd1) gRNA:
PD-1 gRNA Fwd:
(SEQ ID NO: 393)
TGAATGACCAGGGTACCTGCG gRNA common Rev:
(SEQ ID NO: 394)
TTCAAGTTGATAACGGACTAGCC -continued Cas9 N-terminus:
skpp-132 Fwd:
(SEQ ID NO: 395)
TAGGATTACTGCTCGGTGAC Cas9 NT Rev:
(SEQ ID NO: 396)
CGTTGATGGGGTTTTCCTC Cas9 C-terminus:
Cas9 CT Fwd:
(SEQ ID NO: 397)
AGATGATCGCCAAGAGCGAG skpp-11 Rev:
(SEQ ID NO: 398)
CCAAATAGGATGTGTGCGAC Cycling Conditions:

Incubate at 95° C. for 1 minute;

Perform 45 cycles of 95° C. 10 seconds, 60° C. 20 seconds, and 72° C. 30 seconds.

Perform a 65-95° C. melt curve (0.5° C. increments, 5 seconds each).

Quantification of Nanocage and Cas9 Proteins in EPNs (Western Blot)

EPNs were lysed by boiling for 10 minutes in 1× protein sample buffer (25 mM Tris, pH 6.8, 2% SDS, 10% glycerol, 0.012% Bromophenol blue, 1 mM DTT, and Pierce protease inhibitor (EDTA-free, Thermo Fisher Scientific)) diluted with lysis buffer (final concentration: 8 mM HEPES, pH 7.5, 60 mM NaCl, 4% glycerol, 0.4% Triton X-100, and 0.4 mM EDTA). EPN lysates were transferred to ice for 2 minutes and then centrifuged at 21130 rcf for 7.5 minutes.

293T recipient cells were lysed 16-24 hours after EPN delivery by incubating in lysis buffer (20 mM HEPES, pH 7.5, 150 mM NaCl, 10% glycerol, 1% Triton X-100, and 1 mM EDTA, 1 mM DTT, and Pierce protease inhibitor (EDTA-free, Thermo Fisher Scientific)) on ice for 15 minutes. Lysate debris was then pelleted by centrifugation at 21,130 rcf for 15 minutes at 4° C. Lysate supernatant was then mixed with 5× protein sample buffer (to 1× final concentration: 25 mM Tris, pH 6.8, 2% SDS, 10% glycerol, 0.012% Bromophenol blue) and boiled for 7 minutes.

EPN and recipient cell lysates were separated on Bolt 4-12% Bis-Tris Plus polyacrylamide gels (Thermo Fisher Scientific) and transferred to Immobilon-FL PVDF membranes (Thermo Fisher Scientific). After blocking membranes in 5% BSA in TBST (tris-buffered saline, pH 7.4, supplemented with 0.1% Tween 20) for at least 30 minutes at room temperature, membranes were incubated in primary antibody (listed below) overnight at 4° C., washed in TBST, incubated in secondary antibody for 45 minutes at room temperature, washed in TBST, and then visualized using Pierce ECL or ECL Plus Western blotting substrate (Thermo Fisher Scientific).

Antibodies:

Mouse anti-Cas9 (1:1000, clone 7A9-3A3, Cell Signaling Technologies)

Mouse anti-Myc (1:500, clone 9B11, Cell Signaling Technologies)

Mouse anti-HA (1:1000, clone 6E2, Cell Signaling Technologies)

Goat anti-mouse IgG HRP (1:20,000, Jackson Immuno Research Labs, Thermo Fisher Scientific)

Delivery of Cas9/gRNA EPNs to 293T Cells, tertHF Cells, THP-1 Cells, and Jax Mouse Embryonic Fibroblasts (MEFs).

293T cells and tertHF cells were seeded at 50,000 cells/well and Jax MEFs were seeded at 25,000 cells/well in a 48-well plate one day prior to EPN delivery. THP-1 cells were seeded at 50,000 cells/well in a 48-well plate directly before EPN delivery. For delivery, EPNs were diluted in DMEM supplemented with 10% fetal bovine serum and added to each well containing recipient cells. In some experiments, immediately after adding EPNs, plates were centrifuged at 453 rcf for 30 minutes at room temperature to improve EPN delivery. Cells were harvested for analysis of Cas9 protein expression 16-24 hours later or for analysis of gene editing 72-96 hours later.

Analysis of Gene Editing (RFLP Assay)

DNA was isolated from cells by alkaline lysis by incubating cells at 95-100° C. in solution I (25 mM NaOH, 0.2 mM EDTA pH 12) for 30-45 minutes, then adding an equal volume of solution II (40 mM Tris, pH 5).

The exon of AIM2 (AIM42) targeted by gRNA10 was amplified with the primers and cycling conditions listed below using Phusion High-Fidelity DNA polymerase (New England Biolabs) per manufacturer's instructions with Phusion HF buffer (1× final concentration), 200 uM dNTPs, 300 nM primers, 3% DMSO, and 0.4 units Phusion DNA polymerase. PCR products were then digested with the restriction enzyme MwoI (2.5 units, New England Biolabs) in 1× CutSmart Buffer for 3 hours at 60° C. Digested PCR products were separated by gel electrophoresis using a 3% MetaPhor Agarose gel (Lonza).

Primers:

AIM2 (AIM2):
AIM2 Fwd:
(SEQ ID NO: 399)
CTGAACAGAAACAGATGGTGGC

AIM2 Rev:
(SEQ ID NO: 400)
CCTTCTGGACTACAAACAAACC
Or,

AIM2 Fwd2:
(SEQ ID NO: 401)
TCTGCTGGCTTTCTGAGGTT

AIM2 Rev2:
(SEQ ID NO: 402)
GGCATGTTTACTCTGCAGCTC

Cycling Conditions:

Incubate at 98° C. for 5 minutes;

Perform 35-40 cycles of 95° C. 10 seconds, 60° C. 20 seconds, and 72° C. 20 seconds.

Incubate at 72° C. for 10 minutes.

The exon of CD18 (ITGB2) targeted by gRNA9 was amplified with the primers and cycling conditions listed below using Phusion High-Fidelity DNA polymerase (New England Biolabs) per manufacturer's instructions with Phusion (C-rich buffer (1× final concentration), 200 uM dNTPs, 300 nM primers, 3% DMSO, and 0.4 units Phusion DNA polymerase. PCR products were then digested with the restriction enzyme SexAI (2.5 units, New England Biolabs) in 1× CutSmart Buffer for 3 hours at 37° C. Digested PCR products were separated by gel electrophoresis using a 3% MetaPhor Agarose gel (Lonza).

Primers:

CD18 (ITGB2):
CD18 Fwd:
CGACATCATGGACCCCACAA (SEQ ID NO: 403)

CD18 Rev:
GGGCGTTTCTCAAAGCACTG (SEQ ID NO: 404)

Cycling Conditions:
Incubate at 98° C. for 5 minutes;
Perform 35-40 cycles of 95° C. 10 seconds, 66° C. 20 seconds, and 72° C. 30 seconds.
Incubate at 72° C. for 10 minutes.

The exon of PD-1 (Pdcd1) targeted by gRNA64 was amplified with the primers and cycling conditions listed below using Phusion High-Fidelity DNA polymerase (New England Biolabs) per manufacturer's instructions with Phusion (GC-rich buffer (1× final concentration), 200 uM dNTPs, 300 nM primers, and 0.4 units Phusion DNA polymerase. PCR products were then digested with the restriction enzyme KpnI-HF (10 units, New England Biolabs) in 1× CutSmart Buffer for 3 hour at 37° C. Digested PCR products were separated by gel electrophoresis using a 3% MetaPhor Agarose gel (Lonza)

PD-1 (Pdcd1):
PD-1 Fwd:
CCTCCAACATGACCTGGGAC (SEQ ID NO: 405)

PD-1 Rev:
AGCCACCAACCCCAATTGAT (SEQ ID NO: 406)

Cycling Conditions:
Incubate at 98° C. for 5 minutes;
Perform 35-40 cycles of 95° C. 10 seconds, 60° C. 20 seconds, and 72° C. 20 seconds.
Incubate at 72° C. for 10 minutes.

Quantification of Cell Death Following Cas9/gRNA Delivery (Incucyte)

tertHF cells were seeded at 25,000 cells/well in a 48-well plate and then transfected with 250 ng each pCMV-Cas9-1g70_PRE and pUC-gRNA10-loop-1g70 expression plasmids using Lipofectamine 2000 (Life Technologies) or incubated with 12.5-25 ug EPNs. Cell death was assayed with a 2-color IncuCyte Zoom In-incubator imaging system (Essen Biosciences, Ann Arbor, MI, USA) and analyzed as described (Orozco et al., 2014). SytoxGreen and SytoGreen (25 nM, Life Technologies) were used to quantify the frequency of dead cells.

Quantification of Pyroptosis after AIM2 Gene Editing (Incucyte)

THP-1 cells were seeded at 50,000 cells/well in a 48-well plate, and 25 ug of EPNs containing Cas9/gRNA were delivered to disrupt either the AIM2 (AIM2) or ITGB2 (CD18) loci. Ten days later the edited cells were differentiated by seeding at a density of $4 \times 10^4$ cells per well in a 48-well plate in 100 nM PMA. After 24 hours, PMA-containing media was aspirated and cells were cultured for an additional 24 hours in fresh media (without PMA). Cells were then primed with 20 U/ml hIFNb for 5 hours and transfected with 1 µg calf thymus DNA (CT-DNA) using Lipofectamine 2000 (Life Technologies). Cell death due to pyroptosis was assayed with a 2-color IncuCyte Zoom In-incubator imaging system (Essen Biosciences, Ann Arbor, MI, USA) and analyzed as previously described[2]. SytoxGreen and SytoGreen (25 nM, Life Technologies) were used to quantify the frequency of dead cells.

Cloning

Vector backbones were prepared for cloning by restriction digest followed by agarose gel purification using a Qiagen kit. Plasmids encoding the EPN structural proteins or Cas9 were prepared by digesting pCMV with XhoI and either KpnI or NotI. The gRNA plasmids were prepared by digesting pUC 19 with KpnI only. The genes of interest were produced by gene synthesis or PCR mutagenesis and were prepared for cloning by PCR amplification with primers that added 15-40 base pairs of homology corresponding to the destination vector. Gibson assembly or InFusion was used to assemble the desired insert into the desired vector. These reactions were transformed into NEB Turbo or XL1-blue chemically competent cells according to the manufacturer's protocols and then plated on LB-agar plates supplemented with 50 µg/mL carbenicillin. Candidate colonies were analyzed by sanger sequencing (Genewiz) to confirm the correct plasmid sequences. Purified plasmid DNA was prepared using a Qiagen miniprep kit, a Clontech MidiPrep kit, or a Clontech Endofree MidiPrep kit according to the manufacturers' instructions.

Sequences of Proteins

EPN proteins: EPN-11-1g70, EPN-11-mnb, EPN-11-HIV_NC, EPN-11-u1a, EPN-11-com, EPN-11-1wa3-1g70, EPN-11-1wa3-mnb, EPN-11-1wa3-u1a, EPN-01-mnb, EPN-01-1wa3-mnb, EPN-11, EPN-11-1wa3, EPN-01, EPN-01-1wa3

Cas9 proteins: Cas9, Cas9-t2a-Puro

Cas9 mRNAs: FLAG-Cas9-1g70_WPRE, FLAG-Cas9-mnb, FLAG-Cas9-mnb-WPRE, FLAG-Cas9-HIV_NC-WPRE, FLAG-Cas9-u1a-WPRE, FLAG-Cas9-com-WPRE, FLAG-Cas9-noHP_WPRE, Cas9-t2a-Puro mRNAs: FLAG-Cas9-t2a-Puro-1g70_WPRE, FLAG-Cas9-t2a-Puro-mnb-WPRE, FLAG-Cas9-t2a-Puro-HIV_NC-WPRE, FLAG-Cas9-t2a-Puro-u1a_WPRE, FLAG-Cas9-t2a-Puro-com-WPRE, FLAG-Cas9-t2a-Puro-noHP_WPRE gRNAs: gRNA10op-loop-1g70, gRNA10op-3-1g70, gRNA10op_loop-1g70-WPRE, gRNA10op_3-1g70-WPRE, gRNA10op_3-2x1g70-dslinker, gRNA10op_3-2x1g70, gRNA10op_loop-u1a, gRNA9 op_loop-u1a, gRNA9 op_3-u1a, gRNA64 op_loop-1g70, gRNA10op_3-u1a, gRNA65 op_loop-1g70

Fusion proteins: VSV-G, VSV-G-MYC, Ecotropic envelope protein from Moloney Murine Leukemia Virus (Eco), Amphotropic Murine Leukemia Virus Envelope 4070A, Sindbis virus E3-E2-6K-E1 envelope polyprotein, Ebola GP (Zaire Mayinga strain), Human Immunodeficiency Virus envelope glycoprotein precursor gp160, Respiratory Syncytial Virus F protein precursor, SARS Coronavirus spike protein, Influenza hemagglutinin RNA-binding domains (RBDs): mnb RBD, 1g70 RBD, HIV_NC RBD, u1a RBD, com RBD RNA packaging sequences: mnb RNA packaging sequence, 1g70 RNA packaging sequence, HIV_NC RNA packaging sequence, u1a RNA packaging sequence, com RNA packaging sequence Results EPN-delivered Cas9/gRNA performs efficient gene editing in HEK293T, tertHF, THP-1, and Jax MEF cells (FIG. 4, FIGS. 6-8).

Figure 5:
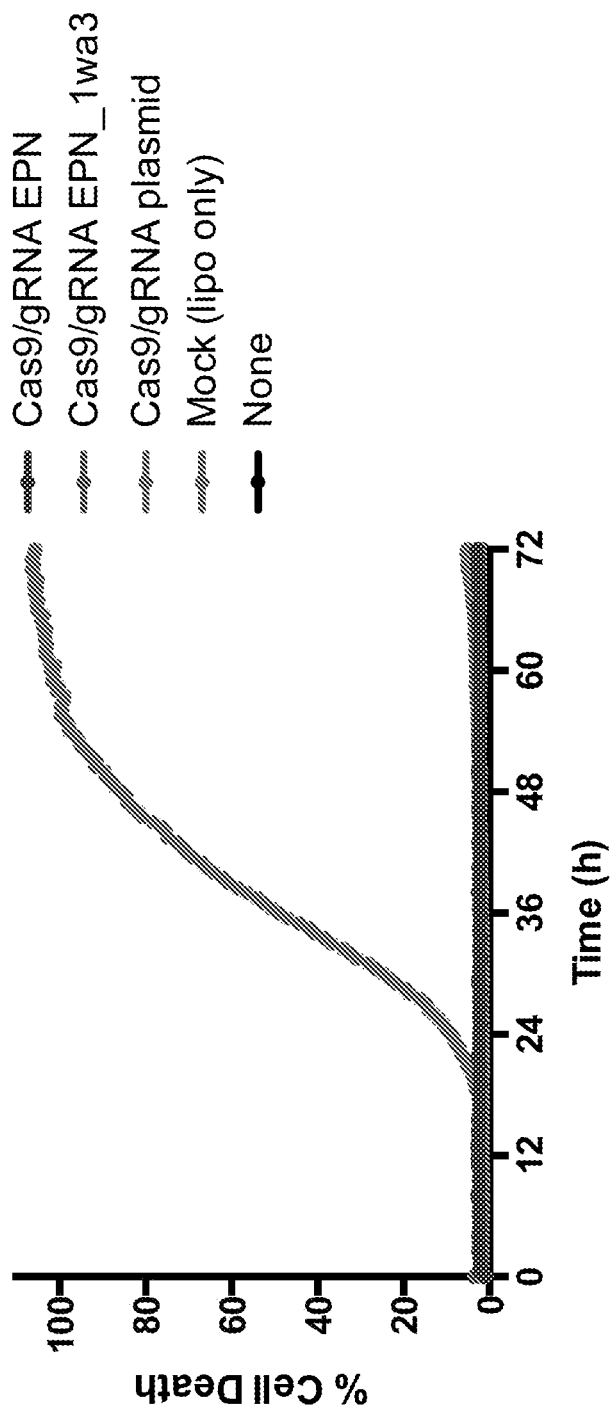
FIG. 5: Delivery of Cas9/gRNA EPNs to human fibroblasts does not cause cell death. Cell death of telomerase-immortalized human fibroblasts (tertHFs) following delivery of 12.5 µg Cas9/gRNA EPNs or transfection (using lipofectamine) of Cas9 and gRNA expression plasmids (250 ng each) quantified using an IncuCyte imaging system. Lipofection of plasmid DNA was highly toxic, whereas no toxicity was observed for Cas9/gRNA EPN delivery.

EPN-delivered Cas9/gRNA is less toxic than DNA lipofection in tertHF cells (FIG. 5).

Figure 6:
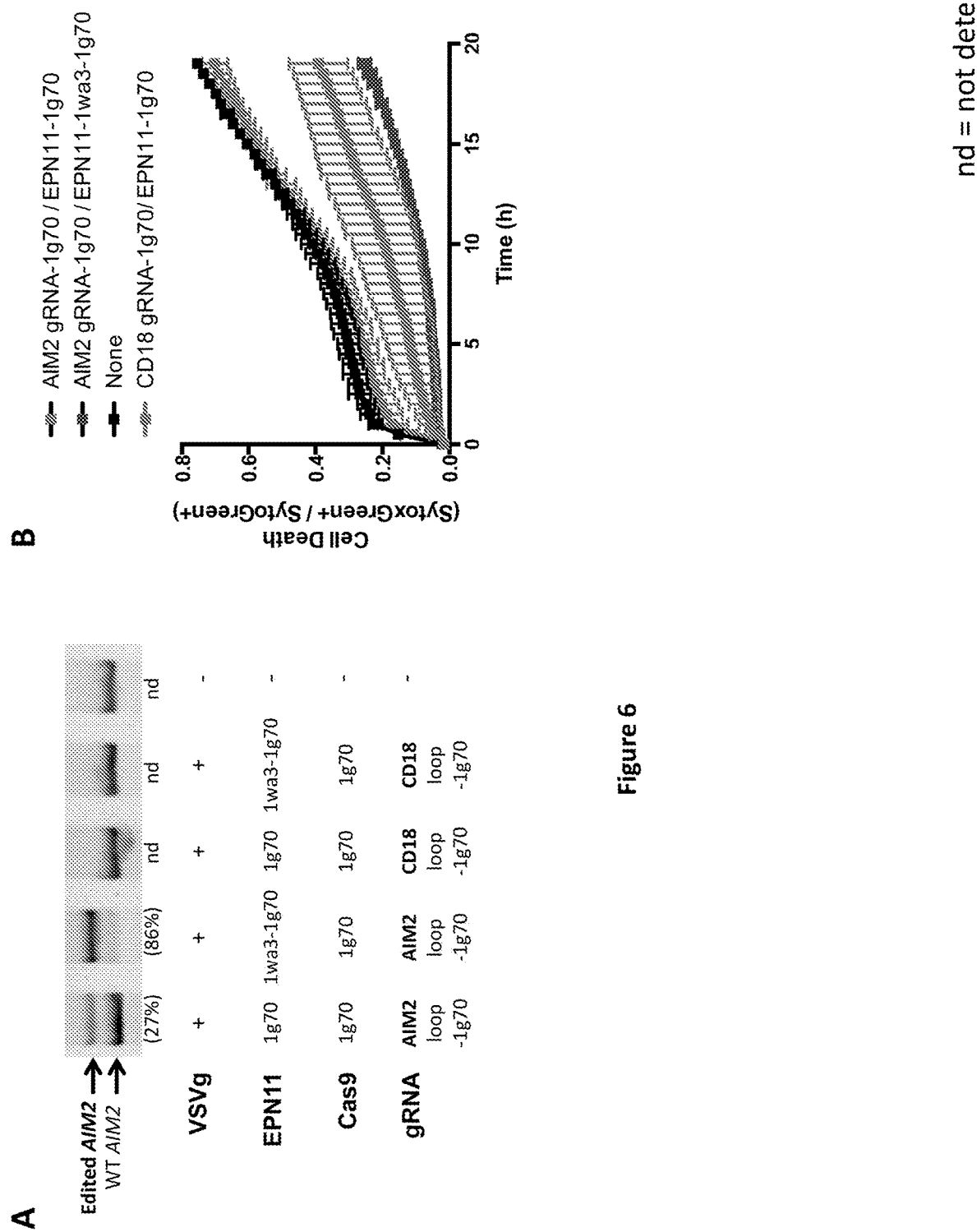
FIG. 6. Disruption of AIM2 in THP-1 cells prevents pyroptosis. (A) Analysis of AIM2 gene editing (% of edited alleles) 3 days after delivery of 25 µg Cas9/gRNA EPNs targeting AIM2 (AIM2, on-target) or ITGB2 (CD18, off-target) to 50,000 THP-1 cells. (B) Loss of AIM2 function was evaluated by measuring pyroptosis (cell death) in response to transfected DNA in THP-1 cells 12 days following delivery of EPNs (as described in (A)). AIM2 editing reduced pyroptotic cell death.

EPN-delivered Cas9/gRNA results in gene editing at the AIM2 locus that prevents pyroptoss[3-5] in THP-1 cells (FIG. 6).

Genome editing performed at the AIM2, CD18, and Pdcd1 loci (FIG. 4, and FIGS. 6-8).

Non-assembling EPN-11-1wa3 still recruits ESCRT machinery to the cytoplasmic membrane and induces extracellular vesicle formation, suggesting that targeting ESCRT machinery to the membrane is sufficient to induce budding.

Figure 7:
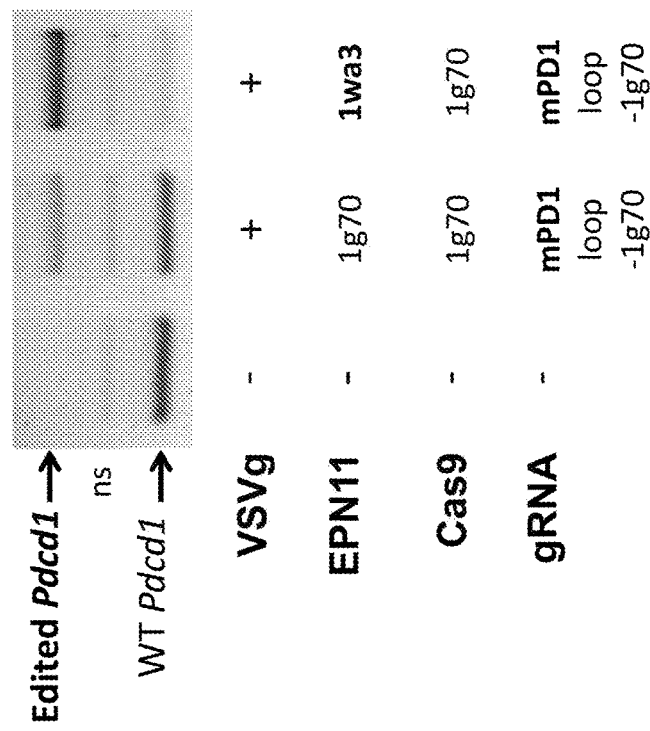
FIG. 7. Delivery of Cas9/gRNA EPNs to mouse cells results Pdcd1 (PD-1) gene editing. Analysis of Pdcd1 gene editing (% of edited alleles) 3 days after delivery of 25 µg Cas9/gRNA EPNs to 25,000 mouse embryonic fibroblasts (Jax MEFs).
Figure 8:
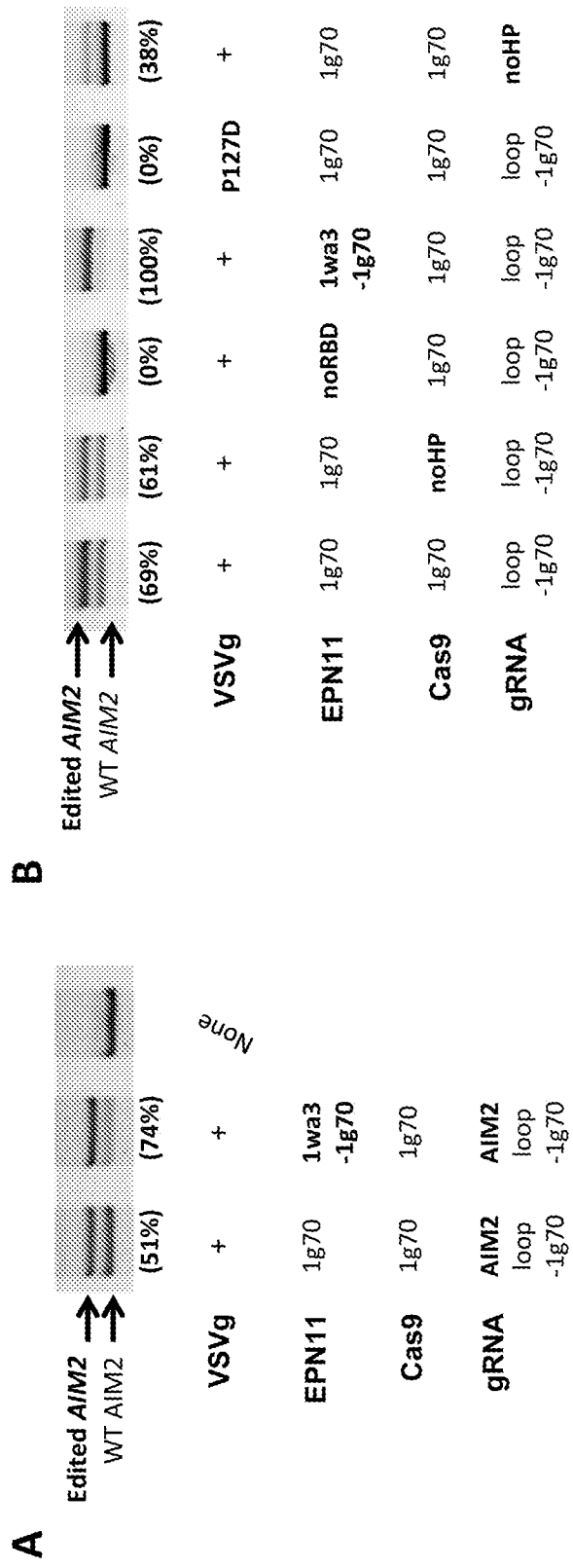
FIG. 8: Delivery of non-assembling Cas9/gRNA EPNs to mammalian cells results in enhanced AIM2 gene editing. (A) Analysis of AIM2 gene editing (% of edited alleles) 4 days after delivery of 25 µg Cas9/gRNA EPNs to 25,000 tertHF cells. (B) Analysis of AIM2 gene editing (% of edited alleles) 3 days after delivery of 25 µg Cas9/gRNA EPNs to 50,000 293T cells.

EPNs derived from non-assembling EPN-11-1wa3 are able to package and deliver Cas9/gRNA into recipient cells (THP-1, HEK293T (293T), tertHF and Jax MEF cells) for gene editing (FIG. 6-8).

Figure 9:
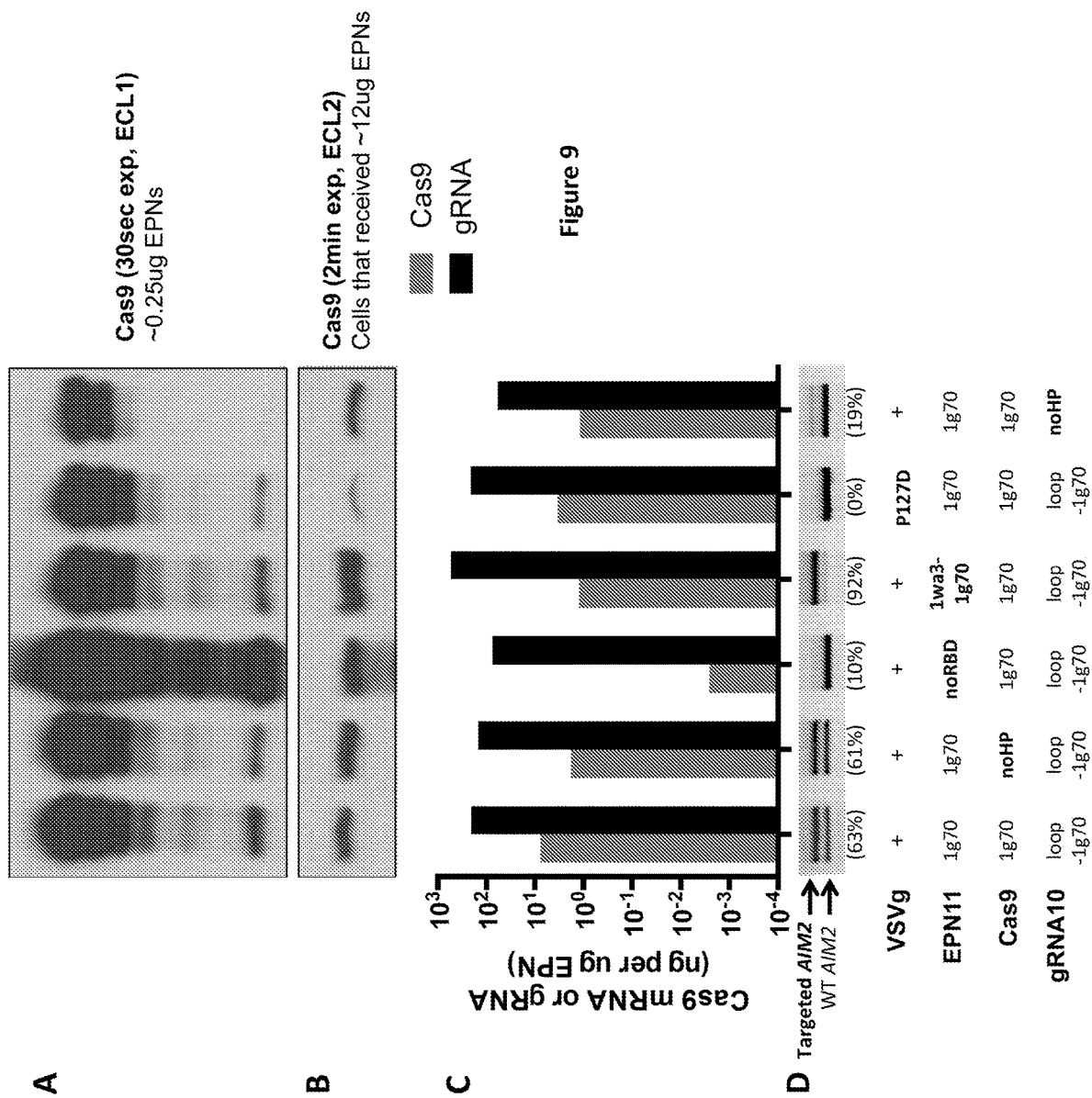
FIG. 9: Delivery of gRNA and Cas9 mRNA is associated with gene editing efficiency. Anti-Cas9 Western blots were performed on (A) 0.25 µg Cas9/gRNA EPNs or (B) on recipient cells 1 day after delivery of 12 µg Cas9/gRNA EPNs to 50,000 HEK293T cells. (C) RT-qPCR quantitation of gRNA and Cas9 mRNA packaged in Cas9/gRNA EPNs.

Delivery of gRNA, Cas9 mRNA, and Cas9 protein are associated with gene editing (FIG. 9).

REFERENCES

1. Votteler, J. et al. Designed proteins induce the formation of nanocage-containing extracellular vesicles. *Nature* 540, 292-295 (2016).
2. Orozco, S. et al. RIPK1 both positively and negatively regulates RIPK3 oligomerization and necroptosis. *Cell Death Differ.* 21, 1511-1521 (2014).
3. Fernandes-Alnemri, T. et al. The AIM2 inflammasome is critical for innate immunity to *Francisella tularensis*. *Nat. Immunol.* 11, 385-393 (2010).
4. Rathinam, V. A. K. et al. The AIM2 inflammasome is essential for host defense against cytosolic bacteria and DNA viruses. *Nat. Immunol.* 11, 395-402 (2010).
5. Jones, J. W. et al. Absent in melanoma 2 is required for innate immune recognition of *Francisella tularensis*. *Proc. Natl. Acad. Sci. U.S.A* 107, 9771-6 (2010).

SEQUENCE LISTING (415 sequences)

SEQ ID NO: 1 - protein, 184 aa, Artificial Sequence
  Synthetic
  MISC_FEATURE (1)..(1): optionally absent
  MISC_FEATURE (2)..(3): Xaa is any amino acid
  MISC_FEATURE (11)..(11): Xaa is any amino acid
  MISC_FEATURE (25)..(25): Xaa is any amino acid
  MISC_FEATURE (28)..(28): Xaa is any amino acid
  MISC_FEATURE (30)..(30): Xaa is any amino acid
  MISC_FEATURE (35)..(35): Xaa is any amino acid
  MISC_FEATURE (38)..(39): Xaa is any amino acid
  MISC_FEATURE (41)..(41): Xaa is any amino acid
  MISC_FEATURE (49)..(50): Xaa is any amino acid
  MISC_FEATURE (55)..(55): Xaa is any amino acid
  MISC_FEATURE (68)..(70): Xaa is any amino acid
  MISC_FEATURE (72)..(72): Xaa is any amino acid
  MISC_FEATURE (75)..(76): Xaa is any amino acid
  MISC_FEATURE (78)..(79): Xaa is any amino acid
  MISC_FEATURE (83)..(83): Xaa is any amino acid
  MISC_FEATURE (86)..(88): Xaa is any amino acid
  MISC_FEATURE (90)..(90): Xaa is any amino acid
  MISC_FEATURE (92)..(95): Xaa is any amino acid
  MISC_FEATURE (103)..(103): Xaa is any amino acid
  MISC_FEATURE (114)..(114): Xaa is any amino acid
  MISC_FEATURE (117)..(117): Xaa is any amino acid
  MISC_FEATURE (120)..(120): Xaa is any amino acid
  MISC_FEATURE (127)..(127): Xaa is any amino acid
  MISC_FEATURE (130)..(130): Xaa is any amino acid
  MISC_FEATURE (133)..(133): Xaa is any amino acid
  MISC_FEATURE (143)..(143): Xaa is any amino acid
  MISC_FEATURE (162)..(162): Xaa is any amino acid
  MISC_FEATURE (171)..(172): Xaa is any amino acid
  MISC_FEATURE (174)..(175): Xaa is any amino acid
  MISC_FEATURE (178)..(179): Xaa is any amino acid
  MISC_FEATURE (183)..(184): Xaa is any amino acid
MXXAIGILELXSIAAGMELGDAMLXSAXVXLLVSXTIXXGXFLLMLGGXXGAIQXAIETGTSQAGELXXXSXVLXXIXXSVLXAIXXXNXVXXXXAVGIVETXSVAACISAADXAVXGSXVTLVRVXMAXGIXGKCYMVVAGXVSDVALAVTVASSSAGAYXLLVYASLIXXPXXAMXXQMVXX

SEQ ID NO: 2 - protein, 184 aa, Artificial Sequence
  Synthetic
  MISC_FEATURE (1)..(1): optionally absent
MSQAIGILELTSIAKGMELGDAMLKSANVDLLVSKTICPGKFLLMLGGDIGAIQQAIETGTSQAGEMLVDSLVLANIHPSVLPAISGLNSVDKRQAVGIVETWSVAACISAADRAVKGSNVTLVRVHMAFGIGGKCYMVVAGDVSDVNNAVTVASESAGEKGLLVYRSVIPRPHEAMWRQMVEG

SEQ ID NO: 3 - protein, 184 aa, Artificial Sequence
  Synthetic
  MISC_FEATURE (1)..(1): optionally absent
MSQAIGILELTSIAAGMELGDAMLKSANVDLLVSKTISPGKFLLMLGGDIGAIQQAIETGTSQAGELLVDSLVLANIHPSVLPAISGLNSVDKRQAVGIVETWSVAACISAADRAVKGSNVTLVRVHMAFGIGGKCYMVVAGDVSDVALAVTVASSSAGAYGLLVYASLIPRPHEAMWRQMVEG

SEQ ID NO: 4 - protein, 199 aa, Artificial Sequence
  Synthetic
  MISC_FEATURE (1)..(1): optionally absent
  MISC_FEATURE (2)..(10): Xaa is any amino acid
  MISC_FEATURE (13)..(13): Xaa is any amino acid
  MISC_FEATURE (16)..(16): Xaa is any amino acid
  MISC_FEATURE (19)..(19): Xaa is any amino acid
  MISC_FEATURE (21)..(21): Xaa is any amino acid
  MISC_FEATURE (41)..(41): Xaa is S or V
  MISC_FEATURE (42)..(42): Xaa is any amino acid
  MISC_FEATURE (44)..(44): Xaa is L or M
  MISC_FEATURE (45)..(45): Xaa is K or M
  MISC_FEATURE (46)..(46): Xaa is any amino acid
  MISC_FEATURE (58)..(59): Xaa is any amino acid
  MISC_FEATURE (61)..(61): Xaa is any amino acid
  MISC_FEATURE (75)..(75): Xaa is any amino acid
  MISC_FEATURE (78)..(79): Xaa is any amino acid
  MISC_FEATURE (92)..(92): Xaa is any amino acid
  MISC_FEATURE (94)..(94): Xaa is any amino acid
  MISC_FEATURE (97)..(97): Xaa is any amino acid
  MISC_FEATURE (111)..(111): Xaa is any amino acid
  MISC_FEATURE (114)..(114): Xaa is any amino acid
  MISC_FEATURE (116)..(118): Xaa is any amino acid
  MISC_FEATURE (121)..(121): Xaa is any amino acid
  MISC_FEATURE (123)..(123): Xaa is any amino acid
  MISC_FEATURE (125)..(125): Xaa is any amino acid
  MISC_FEATURE (130)..(130): Xaa is any amino acid
  MISC_FEATURE (148)..(148): Xaa is any amino acid
  MISC_FEATURE (151)..(151): Xaa is any amino acid
  MISC_FEATURE (163)..(164): Xaa is any amino acid
  MISC_FEATURE (166)..(168): Xaa is any amino acid
  MISC_FEATURE (172)..(172): Xaa is any amino acid
  MISC_FEATURE (175)..(175): Xaa is any amino acid
  MISC_FEATURE (177)..(181): Xaa is any amino acid
  MISC_FEATURE (183)..(183): Xaa is any amino acid
  MISC_FEATURE (185)..(186): Xaa is any amino acid
MXXXXXXXXXKWXDAXFDXTXINERLRAKVICFALNHTNPXXTXXXKVLIDALFQTTXXNXSISIPFDTDYGWNXKLXXNVYVNTNCYFMDXGXITXGDNVFIGPNCGFYXATXPXXXHHXNXGXEKAGXIHIGSNTWFGGHVAVLPXVTXGEGSVIGAGSVXXKXXXPHSXAVXNXXXXXRXIXXDLPSETLNDETIK

SEQ ID NO: 5 - protein, 199 aa, Artificial Sequence
  Synthetic
  MISC_FEATURE (1)..(1): optionally absent
MTEKEKMLAEKWYDANFDQYLINERARAKDICFELNHTRPSATNKRKELIDQLFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 6 - protein, 184 aa, Artificial Sequence; identical to SEQ ID NO: 2
  Synthetic
  MISC_FEATURE (1)..(1): optionally absent

SEQ ID NO: 7 - protein, 199 aa, Artificial Sequence
  Synthetic
  MISC_FEATURE (1)..(1): optionally absent
MTEKEKMLAEKWYDANFDQTLINERLRAKVICFALNHTNPSATLKRKVLIDALFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 8 - protein, 199 aa, Artificial Sequence
  Synthetic
  MISC_FEATURE (1)..(1): optionally absent
MTEKEKMLAEKWYDANFDQTLINERLRAKVICFALNHTNPVATMMRKVLIDALFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 9 - protein, 199 aa, Artificial Sequence
  Synthetic
  MISC_FEATURE (1)..(1): optionally absent
  MISC_FEATURE (41)..(41): Xaa is S or V
  MISC_FEATURE (44)..(44): Xaa is L or M
  MISC_FEATURE (45)..(45): Xaa is K or M
MTEKEKMLAEKWYDANFDQTLINERLRAKVICFALNHTNPXATXXRKVLIDALFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 10 - protein, 159 aa, Artificial Sequence
  Synthetic
  MISC_FEATURE (1)..(1): optionally absent
MGEVPIGDPKELNGMEIAAVYLQPIEMEPRGIDLAASLADIHLEADIHALKNNPNGFPEGFWMPYLTIAYALANADTGAIKTGTLMPMVADDGPHYGANIAMEKDKKGGFGVGTYALTFLISNPEKQGFGRHVDEETGVGKWFEPFVVTYFFKYTGTPK

SEQ ID NO: 11 - protein, 184 aa, Artificial Sequence
  Synthetic
  MISC_FEATURE (1)..(1): optionally absent
MSQAIGILELTSIAKGMELGDAMLKSANVDLLVSKTISPGKFLLMLGGDIGAIQQAIETGTSQAGEMLVDSLVLANIHPSVLPAISGLNSVDKRQAVGIVETWSVAACISAADLAVKGSNVTLVRVHMAFGIGGKCYMVVAGDVLDVAAAVATASLAAGAKGLLVYASIIPRPHEAMWRQMVEG

SEQ ID NO: 12 - protein, 103 aa, Artificial Sequence
  Synthetic
  MISC_FEATURE (1)..(1): optionally absent
MEEVVLITVPSALVAVKIAHALVEERLAACVNIVPGLTSIYRWQGSVVSDHELLLLVKTTTHAFPKLKERVKALHPYTVPEIVALPIAEGNREYLDWLRENTG

SEQ ID NO: 13 - protein, 122 aa, Artificial Sequence
  Synthetic
  MISC_FEATURE (1)..(1): optionally absent
MVRGIRGAITVEEDTPAAILAATIELLLKMLEANGIQSYEELAAVIFTVTEDLTSAFPAEAARLIGMHRVPLLSAREVPVPGSLPRVIRVLALWNTDTPQDRVRHVYLNEAVRLRPDLESAQ

SEQ ID NO: 14 - protein, 177 aa, Artificial Sequence
  Synthetic
  MISC_FEATURE (1)..(1): optionally absent
MSKAKIGIVTVSDRASAGITADISGKAIILALNLYLTSEWEPIYQVIPDEQDVIETTLIKMADEQDCCLIVTTGGTGPAKRDVTPEATEAVCDRMMPGFGELMRAESLKEVPTAILSRQTAGLRGDSLIVNLPGDPASISDCLLAVFPAIPYCIDLMEGPYLECNEAMIKPFRPKAK

SEQ ID NO: 15 - protein, 122 aa, Artificial Sequence
  Synthetic
  MISC_FEATURE (1)..(1): optionally absent
MVRGIRGAITVNSDTPTSIIIATILLLEKMLEANGIQSYEELAAVIFTVTEDLTSAFPAEAARQIGMHRVPLLSAREVPVPGSLPRVIRVLALWNTDTPQDRVRHVYLSEAVRLRPDLESAQ

SEQ ID NO: 16 - protein, 172 aa, Artificial Sequence
  Synthetic
  MISC_FEATURE (1)..(1): optionally absent
MRITTKVGDKGSTRLFGGEEVWKDSPIIEANGTLDELTSFIGEAKHYVDEEMKGILEEIQNDIYKIMGEIGSKGKIEGISEERIAWLLKLILRYMEMVNLKSFVLPGGTLESAKLDVCRTIARRALRKVLTVTREFGIGAEAAAYLLALSDLLFLLARVIEIEKNKLKEVRS

SEQ ID NO: 17 - protein, 123 aa, Artificial Sequence
  Synthetic
  MISC_FEATURE (1)..(1): optionally absent
MPHLVIEATANLRLETSPGELLEQANKALFASGQFGEADIKSRFVTLEAYRQGTAAVERAYLHACLSILDGRDIATRTLLGASLCAVLAEAVAGGGEEGVQVSVEVREMERLSYAKRVVARQR

SEQ ID NO: 18 - protein, 158 aa, Artificial Sequence
  Synthetic
  MISC_FEATURE (1)..(1): optionally absent
MESVNTSFLSPSLVTIRDFDNGQFAVLRIGRTGFPADKGDIDLCLDKMIGVRAAQIFLGDDTEDGFKGPHIRIRCVDIDDKHTYNAMVYVDLIVGTGASEVERETAEEEAKLALRVALQVDIADEHSCVTQFEMKLREELLSSDSFHPDKDEYYKDFL

SEQ ID NO: 19 - protein, 113 aa, Artificial Sequence
  Synthetic
  MISC_FEATURE (1)..(1): optionally absent
MPVIQTFVSTPLDHHKRLLLAIIYRIVTRVVLGKPEDLVMMTFHDSTPMHFFGSTDPVACVRVEALGGYGPSEPEKVTSIVTAAITAVCGIVADRIFVLYFSPLHCGWNGTNF

SEQ ID NO: 20 - protein, 113 aa, Artificial Sequence; identical to SEQ ID NO: 19
  Synthetic
  MISC_FEATURE (1)..(1): optionally absent

SEQ ID NO: 21 - protein, 205 aa, Artificial Sequence
  Synthetic
  MISC_FEATURE (1)..(1): optionally absent
MKMEELFKKHKIVAVLRANSVEEAKEKALAVFEGGVHLIEITFTVPDADTVIKELSFLKEKGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPDEVREKAKAFVEKIRGCTE

SEQ ID NO: 22 - protein, 159 aa, Artificial Sequence
  Synthetic
  MISC_FEATURE (1)..(1): Xaa is any amino acid or is optionally absent
  MISC_FEATURE (2)..(3): Xaa is any amino acid
  MISC_FEATURE (4)..(4): Xaa is A, C, G, P, M, V, I, L, Selenomethionine (Sme), or Selenocysteine (Sce)
  MISC_FEATURE (5)..(5): Xaa is any amino acid
  MISC_FEATURE (6)..(7): Xaa is A, C, G, P, M, V, I, L, Sme, or Sce
  MISC_FEATURE (8)..(9): Xaa is any amino acid
  MISC_FEATURE (10)..(10): Xaa is R, H, or K
  MISC_FEATURE (11)..(13): Xaa is any amino acid
  MISC_FEATURE (14)..(15): Xaa is A, C, G, P, M, V, I, L, Sme, or Sce
  MISC_FEATURE (16)..(16): Xaa is D or E
  MISC_FEATURE (17)..(17): Xaa is any amino acid
  MISC_FEATURE (18)..(20): Xaa is A, C, G, P, M, V, I, L, Sme, or Sce
  MISC_FEATURE (21)..(21): Xaa is F, W, or Y
  MISC_FEATURE (22)..(22): Xaa is A, C, G, P, M, V, I, L, Sme, or Sce
  MISC_FEATURE (23)..(23): Xaa is any amino acid
  MISC_FEATURE (24)..(25): Xaa is A, C, G, P, M, V, I, L, Sme, or Sce
  MISC_FEATURE (26)..(26): Xaa is any amino acid
  MISC_FEATURE (27)..(27): Xaa is A, C, G, P, M, V, I, L, Sme, or Sce
  MISC_FEATURE (28)..(32): Xaa is any amino acid
  MISC_FEATURE (33)..(33): Xaa is D or E
  MISC_FEATURE (34)..(34): Xaa is A, C, G, P, M, V, I, L, Sme, or Sce
  MISC_FEATURE (35)..(35): Xaa is any amino acid
  MISC_FEATURE (36)..(36): Xaa is A, C, G, P, M, V, I, L, Sme, or Sce
  MISC_FEATURE (37)..(38): Xaa is any amino acid
  MISC_FEATURE (39)..(39): Xaa is A, C, G, P, M, V, I, L, Sme, or Sce
  MISC_FEATURE (40)..(40): Xaa is D or E
  MISC_FEATURE (41)..(41): Xaa is A, C, G, P, M, V, I, L, Sme, or Sce
  MISC_FEATURE (42)..(42): Xaa is R, H or K
  MISC_FEATURE (43)..(43): Xaa is any amino acid
  MISC_FEATURE (44)..(44): Xaa is D or E
  MISC_FEATURE (45)..(45): Xaa is A, C, G, P, M, V, I, L, Sme, or Sce
  MISC_FEATURE (46)..(46): Xaa is any amino acid
  MISC_FEATURE (47)..(47): Xaa is A, C, G, P, M, V, I, L, Sme, or Sce
  MISC_FEATURE (48)..(48): Xaa is R, H, or K
  MISC_FEATURE (49)..(50): Xaa is A, C, G, P, M, V, I, L, Sme, or Sce
  MISC_FEATURE (51)..(52): Xaa is any amino acid
  MISC_FEATURE (53)..(53): Xaa is S, T, N, or Q
  MISC_FEATURE (54)..(54): Xaa is any amino acid
  MISC_FEATURE (55)..(55): Xaa is S, T, N, or Q
  MISC_FEATURE (56)..(56): Xaa is A, C, G, P, M, V, I, L, Sme, or Sce
  MISC_FEATURE (57)..(57): Xaa is F, W, or Y
  MISC_FEATURE (58)..(60): Xaa is any amino acid
  MISC_FEATURE (61)..(62): Xaa is F, W, or Y
  MISC_FEATURE (63)..(66): Xaa is any amino acid
  MISC_FEATURE (66)..(66): Xaa is A, C, G, P, M, V, I, L, Sme, or Sce
  MISC_FEATURE (67)..(67): Xaa is S, T, N, or Q
  MISC_FEATURE (68)..(68): Xaa is A, C, G, P, M, V, I, L, Sme, or Sce
  MISC_FEATURE (84)..(84): Xaa is any amino acid
  MISC_FEATURE (85)..(86): Xaa is A, C, G, P, M, V, I, L, Sme, or Sce
  MISC_FEATURE (87)..(87): Xaa is any amino acid
  MISC_FEATURE (88)..(90): Xaa is A, C, G, P, M, V, I, L, Sme, or Sce
  MISC_FEATURE (91)..(92): Xaa is any amino acid
  MISC_FEATURE (93)..(93): Xaa is A, C, G, P, M, V, I, L, Sme, or Sce
  MISC_FEATURE (94)..(94): Xaa is any amino acid
  MISC_FEATURE (95)..(95): Xaa is R, H, or K
  MISC_FEATURE (96)..(96): Xaa is F, W, or Y
  MISC_FEATURE (97)..(98): Xaa is A, C, G, P, M, V, I, L, Sme, or Sce
  MISC_FEATURE (99)..(99): Xaa is S, T, N, or Q
  MISC_FEATURE (100)..(102): Xaa is A, C, G, P, M, V, I, L, Sme, or Sce
  MISC_FEATURE (103)..(104): Xaa is any amino acid
  MISC_FEATURE (105)..(105): Xaa is D or E
  MISC_FEATURE (106)..(107): Xaa is any amino acid
  MISC_FEATURE (108)..(109): Xaa is A, C, G, P, M, V, I, L, Sme, or Sce
  MISC_FEATURE (110)..(110): Xaa is F, W, or Y
  MISC_FEATURE (111)..(111): Xaa is A, C, G, P, M, V, I, L, Sme, or Sce
  MISC_FEATURE (112)..(112): Xaa is any amino acid
  MISC_FEATURE (113)..(113): Xaa is A, C, G, P, M, V, I, L, Sme, or Sce
  MISC_FEATURE (122)..(123): Xaa is S, T, N, or Q
  MISC_FEATURE (124)..(124): Xaa is A, C, G, P, M, V, I, L, Sme, or Sce
  MISC_FEATURE (125)..(125): Xaa is D or E
  MISC_FEATURE (126)..(127): Xaa is any amino acid
  MISC_FEATURE (128)..(128): Xaa is A, C, G, P, M, V, I, L, Sme, or Sce
  MISC_FEATURE (129)..(129): Xaa is F, W, or Y
  MISC_FEATURE (130)..(130): Xaa is A, C, G, P, M, V, I, L, Sme, or Sce
  MISC_FEATURE (131)..(132): Xaa is R, H, or K
  MISC_FEATURE (133)..(133): Xaa is any amino acid
  MISC_FEATURE (134)..(134): Xaa is D or E
  MISC_FEATURE (135)..(136): Xaa is any amino acid
  MISC_FEATURE (137)..(137): Xaa is S, T, N, or Q
  MISC_FEATURE (138)..(140): Xaa is A, C, G, P, M, V, I, L, Sme, or Sce
  MISC_FEATURE (141)..(142): Xaa is any amino acid
  MISC_FEATURE (143)..(143): Xaa is F, W, or Y
  MISC_FEATURE (144)..(144): Xaa is any amino acid
  MISC_FEATURE (153)..(153): Xaa is any amino acid
  MISC_FEATURE (154)..(154): Xaa is F, W, or Y
  MISC_FEATURE (155)..(155): Xaa is any amino acid
  MISC_FEATURE (156)..(156): Xaa is A, C, G, P, M, V, I, L, Sme, or Sce
  MISC_FEATURE (157)..(159): Xaa is any amino acid
XXXXXXXXXXXXXXXXXXXXXXXXXXXXXXXXXXXXXXXXXXXXXXXXXXXXXXXXXXXXXXXXXXXXAYALANADTGAIKTGXXXXXXXXXXXXXXXXXXXXXXXXXXXXXXTYALTFLIXXXXXXXXXXXXXXXXXXXXXXXPFVVTYFFXXXXXXX

SEQ ID NO: 23 - protein, 184 aa, Artificial Sequence
  Synthetic
  MISC_FEATURE (1)..(1): Xaa is any amino acid or optionally absent
  MISC_FEATURE (2)..(2): Xaa is any amino acid
  MISC_FEATURE (3)..(3): Xaa is S, T, N, or Q
  MISC_FEATURE (4)..(8): Xaa is A, C, G, P, M, V, I, L, Selenomethionine (Sme), or Selenocysteine (Sce)
  MISC_FEATURE (9)..(9): Xaa is D or E
  MISC_FEATURE (10)..(10): Xaa is A, C, G, P, M, V, I, L, Sce or Sme
  MISC_FEATURE (11)..(11): Xaa is any amino acid
  MISC_FEATURE (12)..(12): Xaa is S, T, N, or Q
  MISC_FEATURE (13)..(14): Xaa is A, C, G, P, M, V, I, L, Sce or Sme
  MISC_FEATURE (15)..(15): Xaa is R, H, or K
  MISC_FEATURE (16)..(16): Xaa is A, C, G, P, M, V, I, L, Sce or Sme
  MISC_FEATURE (17)..(17): Xaa is any amino acid
  MISC_FEATURE (18)..(18): Xaa is D or E
  MISC_FEATURE (19)..(20): Xaa is A, C, G, P, M, V, I, L, Sce or Sme
  MISC_FEATURE (21)..(21): Xaa is D or E
  MISC_FEATURE (22)..(22): Xaa is any amino acid
  MISC_FEATURE (23)..(24): Xaa is A, C, G, P, M, V, I, L, Sce or Sme
  MISC_FEATURE (25)..(26): Xaa is any amino acid
  MISC_FEATURE (27)..(27): Xaa is A, C, G, P, M, V, I, L, Sce or Sme
  MISC_FEATURE (28)..(28): Xaa is any amino acid
  MISC_FEATURE (29)..(29): Xaa is A, C, G, P, M, V, I, L, Sce or Sme
  MISC_FEATURE (30)..(31): Xaa is any amino acid
  MISC_FEATURE (32)..(33): Xaa is A, C, G, P, M, V, I, L, Sce or Sme
  MISC_FEATURE (34)..(36): Xaa is any amino acid
  MISC_FEATURE (35)..(35): Xaa is R, H, or K
  MISC_FEATURE (37)..(37): Xaa is A, C, G, P, M, V, I, L, Sce or Sme
  MISC_FEATURE (38)..(39): Xaa is any amino acid
  MISC_FEATURE (40)..(40): Xaa is A, C, G, P, M, V, I, L, Sce or Sme
  MISC_FEATURE (41)..(41): Xaa is R, H, or K
  MISC_FEATURE (42)..(42): Xaa is F, W, or Y
  MISC_FEATURE (43)..(48): Xaa is A, C, G, P, M, V, I, L, Sce or Sme
  MISC_FEATURE (49)..(51): Xaa is any amino acid
  MISC_FEATURE (52)..(53): Xaa is A, C, G, P, M, V, I, L, Sce or Sme
  MISC_FEATURE (54)..(55): Xaa is any amino acid
  MISC_FEATURE (56)..(57): Xaa is A, C, G, P, M, V, I, L, Sce or Sme
  MISC_FEATURE (58)..(58): Xaa is any amino acid
  MISC_FEATURE (59)..(59): Xaa is S, T, N, or Q
  MISC_FEATURE (60)..(60): Xaa is A, C, G, P, M, V, I, L, Sce or Sme
  MISC_FEATURE (61)..(63): Xaa is any amino acid
  MISC_FEATURE (64)..(64): Xaa is A, C, G, P, M, V, I, L, Sce or Sme
  MISC_FEATURE (65)..(66): Xaa is any amino acid
  MISC_FEATURE (67)..(67): Xaa is A, C, G, P, M, V, I, L, Sce or Sme
  MISC_FEATURE (68)..(73): Xaa is any amino acid
  MISC_FEATURE (74)..(74): Xaa is A, C, G, P, M, V, I, L, Sce or Sme
  MISC_FEATURE (75)..(76): Xaa is any amino acid
  MISC_FEATURE (77)..(77): Xaa is A, C, G, P, M, V, I, L, Sce or Sme
  MISC_FEATURE (78)..(78): Xaa is R, H, or K
  MISC_FEATURE (79)..(79): Xaa is any amino acid
  MISC_FEATURE (80)..(80): Xaa is S, T, N, or Q
  MISC_FEATURE (81)..(81): Xaa is A, C, G, P, M, V, I, L, Sce or Sme
  MISC_FEATURE (82)..(83): Xaa is any amino acid
  MISC_FEATURE (84)..(84): Xaa is A, C, G, P, M, V, I, L, Sce or Sme
  MISC_FEATURE (85)..(86): Xaa is any amino acid
  MISC_FEATURE (87)..(87): Xaa is A, C, G, P, M, V, I, L, Sce or Sme
  MISC_FEATURE (88)..(95): Xaa is any amino acid
  MISC_FEATURE (97)..(97): Xaa is A, C, G, P, M, V, I, L, Sce or Sme
  MISC_FEATURE (98)..(98): Xaa is S, T, N, or Q
  MISC_FEATURE (99)..(100): Xaa is A, C, G, P, M, V, I, L, Sce or Sme
  MISC_FEATURE (101)..(101): Xaa is D or E
  MISC_FEATURE (102)..(102): Xaa is S, T, N, or Q
  MISC_FEATURE (103)..(103): Xaa is F, W, or Y
  MISC_FEATURE (104)..(104): Xaa is S, T, N, or Q
  MISC_FEATURE (105)..(105): Xaa is A, C, G, P, M, V, I, L, Sce or Sme
  MISC_FEATURE (106)..(106): Xaa is any amino acid
  MISC_FEATURE (107)..(108): Xaa is A, C, G, P, M, V, I, L, Sce or Sme
  MISC_FEATURE (109)..(110): Xaa is any amino acid
  MISC_FEATURE (111)..(112): Xaa is A, C, G, P, M, V, I, L, Sce or Sme
  MISC_FEATURE (112)..(112): Xaa is any amino acid
  MISC_FEATURE (113)..(113): Xaa is D or E
  MISC_FEATURE (116)..(116): Xaa is A, C, G, P, M, V, I, L, Sce or Sme
  MISC_FEATURE (121)..(121): Xaa is A, C, G, P, M, V, I, L, Sce or Sme
  MISC_FEATURE (122)..(122): Xaa is any amino acid
  MISC_FEATURE (123)..(124): Xaa is A, C, G, P, M, V, I, L, Sce or Sme
  MISC_FEATURE (125)..(125): Xaa is R, H, or K
  MISC_FEATURE (126)..(126): Xaa is A, C, G, P, M, V, I, L, Sce or Sme
  MISC_FEATURE (127)..(130): Xaa is any amino acid
  MISC_FEATURE (131)..(131): Xaa is A, C, G, P, M, V, I, L, Sce or Sme
  MISC_FEATURE (132)..(133): Xaa is any amino acid
  MISC_FEATURE (134)..(134): Xaa is A, C, G, P, M, V, I, L, Sce or Sme
  MISC_FEATURE (135)..(135): Xaa is R, H, or K
  MISC_FEATURE (136)..(136): Xaa is A, C, G, P, M, V, I, L, Sce or Sme
  MISC_FEATURE (137)..(137): Xaa is F, W, or Y
  MISC_FEATURE (138)..(142): Xaa is A, C, G, P, M, V, I, L, Sce or Sme
  MISC_FEATURE (158)..(158): Xaa is A, C, G, P, M, V, I, L, Sce or Sme
  MISC_FEATURE (161)..(162): Xaa is any amino acid
  MISC_FEATURE (163)..(163): Xaa is A, C, G, P, M, V, I, L, Sce or Sme
  MISC_FEATURE (164)..(165): Xaa is any amino acid
  MISC_FEATURE (166)..(166): Xaa is F, W, or Y
  MISC_FEATURE (173)..(173): Xaa is A, C, G, P, M, V, I, L, Sce or Sme
  MISC_FEATURE (174)..(174): Xaa is R, H, or K
  MISC_FEATURE (175)..(176): Xaa is any amino acid
  MISC_FEATURE (177)..(177): Xaa is A, C, G, P, M, V, I, L, Sce or Sme
  MISC_FEATURE (178)..(178): Xaa is F, W, or Y
  MISC_FEATURE (179)..(184): Xaa is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXXXXXXXXXXXXXLAXKGSNXXXXXXXXXXXXXXXXXXXXXXDVLDVAAAVATASLAXGAXXXXXXASIIPRXXXXXXXXXXXX

SEQ ID NO: 24 - protein, 103 aa, Artificial Sequence
  Synthetic
  MISC_FEATURE (1)..(1): Xaa is any amino acid or optionally absent
  MISC_FEATURE (2)..(3): Xaa is D or E
  MISC_FEATURE (4)..(7): Xaa is A, C, G, P, M, V, I, L, Selenomethionine (Sme), or Selenocysteine (Sce)
  MISC_FEATURE (8)..(8): Xaa is S, T, N, or Q
  MISC_FEATURE (9)..(10): Xaa is A, C, G, P, M, V, I, L, Sce or Sme
  MISC_FEATURE (11)..(11): Xaa is S, T, N, or Q
  MISC_FEATURE (18)..(19): Xaa is A, C, G, P, M, V, I, L, Sce or Sme
  MISC_FEATURE (21)..(23): Xaa is A, C, G, P, M, V, I, L, Sce or Sme
  MISC_FEATURE (24)..(26): Xaa is any amino acid
  MISC_FEATURE (27)..(31): Xaa is A, C, G, P, M, V, I, L, Sce or Sme
  MISC_FEATURE (32)..(32): Xaa is S, T, N, or Q
  MISC_FEATURE (34)..(34): Xaa is A, C, G, P, M, V, I, L, Sce or Sme
  MISC_FEATURE (39)..(39): Xaa is S, T, N, or Q
  MISC_FEATURE (41)..(41): Xaa is any amino acid
  MISC_FEATURE (42)..(42): Xaa is R, H or K
  MISC_FEATURE (44)..(45): Xaa is any amino acid
  MISC_FEATURE (50)..(50): Xaa is D or E
  MISC_FEATURE (52)..(52): Xaa is D or E
  MISC_FEATURE (54)..(57): Xaa is A, C, G, P, M, V, I, L, Sce or Sme
  MISC_FEATURE (58)..(58): Xaa is R, H or K
  MISC_FEATURE (59)..(60): Xaa is S, T, N, or Q
  MISC_FEATURE (61)..(62): Xaa is any amino acid
  MISC_FEATURE (63)..(63): Xaa is A, C, G, P, M, V, I, L, Sce or Sme
  MISC_FEATURE (64)..(64): Xaa is F, W, or Y
  MISC_FEATURE (65)..(66): Xaa is any amino acid
  MISC_FEATURE (67)..(67): Xaa is A, C, G, P, M, V, I, L, Sce or Sme
  MISC_FEATURE (68)..(68): Xaa is R, H or K
  MISC_FEATURE (69)..(70): Xaa is any amino acid
  MISC_FEATURE (71)..(71): Xaa is A, C, G, P, M, V, I, L, Sce or Sme
  MISC_FEATURE (72)..(73): Xaa is any amino acid
  MISC_FEATURE (74)..(74): Xaa is A, C, G, P, M, V, I, L, Sce or Sme
  MISC_FEATURE (75)..(75): Xaa is R, H or K
  MISC_FEATURE (76)..(79): Xaa is any amino acid
  MISC_FEATURE (80)..(80): Xaa is A, C, G, P, M, V, I, L, Sce or Sme
  MISC_FEATURE (81)..(81): Xaa is D or E
  MISC_FEATURE (82)..(87): Xaa is A, C, G, P, M, V, I, L, Sce or Sme
  MISC_FEATURE (88)..(89): Xaa is any amino acid
  MISC_FEATURE (90)..(90): Xaa is A, C, G, P, M, V, I, L, Sce or Sme
  MISC_FEATURE (91)..(91): Xaa is S, T, N, or Q
  MISC_FEATURE (92)..(93): Xaa is any amino acid
  MISC_FEATURE (94)..(94): Xaa is F, W, or Y
  MISC_FEATURE (95)..(95): Xaa is A, C, G, P, M, V, I, L, Sce or Sme
  MISC_FEATURE (96)..(96): Xaa is any amino acid
  MISC_FEATURE (97)..(97): Xaa is F, W, or Y
  MISC_FEATURE (98)..(98): Xaa is A, C, G, P, M, V, I, L, Sce or Sme
  MISC_FEATURE (99)..(100): Xaa is any amino acid
  MISC_FEATURE (101)..(102): Xaa is S, T, N, or Q
  MISC_FEATURE (103)..(103): Xaa is A, C, G, P, M, V, I, L, Sce or Sme
XXXXXXXXXXXALVAVKXXHXXXXXXXXXXXXIXPGLTXIXXWXXSVVSXHXLXXXXXXXXXXXXXXXXXXXXXXXXXXXXXXXXXXXXXXXXXXXXXXXXXX

SEQ ID NO: 25 - protein, 122 aa, Artificial Sequence
  Synthetic
  MISC_FEATURE (1)..(1): Xaa is any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H, or K
  MISC_FEATURE (4)..(5): Xaa is A, C, G, P, M, V, I, L, Sce, or Sme
  MISC_FEATURE (6)..(6): Xaa is R, H, or K
  MISC_FEATURE (7)..(8): Xaa is A, C, G, P, M, V, I, L, Sce, or Sme
  MISC_FEATURE (10)..(10): Xaa is S, T, N, or Q
  MISC_FEATURE (11)..(11): Xaa is A, C, G, P, M, V, I, L, Sce, or Sme
  MISC_FEATURE (14)..(14): Xaa is any amino acid
  MISC_FEATURE (19)..(19): Xaa is A, C, G, P, M, V, I, L, Sce, or Sme
  MISC_FEATURE (23)..(23): Xaa is S, T, N, or Q
  MISC_FEATURE (26)..(27): Xaa is A, C, G, P, M, V, I, L, Sce, or Sme
  MISC_FEATURE (30)..(31): Xaa is A, C, G, P, M, V, I, L, Sce, or Sme
  MISC_FEATURE (33)..(33): Xaa is A, C, G, P, M, V, I, L, Sce, or Sme
  MISC_FEATURE (34)..(34): Xaa is S, T, N, or Q
  MISC_FEATURE (35)..(35): Xaa is any amino acid
  MISC_FEATURE (36)..(36): Xaa is A, C, G, P, M, V, I, L, Sce, or Sme
  MISC_FEATURE (37)..(37): Xaa is any amino acid
  MISC_FEATURE (38)..(38): Xaa is S, T, N, or Q
  MISC_FEATURE (39)..(40): Xaa is any amino acid
  MISC_FEATURE (41)..(41): Xaa is D or E
  MISC_FEATURE (42)..(46): Xaa is A, C, G, P, M, V, I, L, Sce, or Sme
  MISC_FEATURE (47)..(122): Xaa is F, W, or Y
  MISC_FEATURE (48)..(48): Xaa is S, T, N, or Q
  MISC_FEATURE (49)..(49): Xaa is A, C, G, P, M, V, I, L, Sce, or Sme
  MISC_FEATURE (50)..(50): Xaa is S, T, N, or Q
  MISC_FEATURE (51)..(52): Xaa is any amino acid
  MISC_FEATURE (53)..(53): Xaa is A, C, G, P, M, V, I, L, Sce, or Sme
  MISC_FEATURE (54)..(55): Xaa is S, T, N, or Q
  MISC_FEATURE (56)..(56): Xaa is A, C, G, P, M, V, I, L, Sce, or Sme
  MISC_FEATURE (57)..(57): Xaa is F, W, or Y
  MISC_FEATURE (58)..(59): Xaa is A, C, G, P, M, V, I, L, Sce, or Sme
  MISC_FEATURE (62)..(62): Xaa is A, C, G, P, M, V, I, L, Sce, or Sme
  MISC_FEATURE (63)..(63): Xaa is R, H, or K
  MISC_FEATURE (66)..(67): Xaa is A, C, G, P, M, V, I, L, Sce, or Sme
  MISC_FEATURE (69)..(69): Xaa is any amino acid
  MISC_FEATURE (70)..(73): Xaa is A, C, G, P, M, V, I, L, Sce, or Sme
  MISC_FEATURE (74)..(74): Xaa is S, T, N, or Q
  MISC_FEATURE (75)..(75): Xaa is A, C, G, P, M, V, I, L, Sce, or Sme
  MISC_FEATURE (76)..(76): Xaa is R, H, or K
  MISC_FEATURE (77)..(77): Xaa is D or E
  MISC_FEATURE (78)..(78): Xaa is A, C, G, P, M, V, I, L, Sce, or Sme
  MISC_FEATURE (79)..(79): Xaa is any amino acid
  MISC_FEATURE (80)..(80): Xaa is A, C, G, P, M, V, I, L, Sce, or Sme
  MISC_FEATURE (81)..(82): Xaa is any amino acid
  MISC_FEATURE (83)..(83): Xaa is S, T, N, or Q
  MISC_FEATURE (84)..(84): Xaa is A, C, G, P, M, V, I, L, Sce, or Sme
  MISC_FEATURE (85)..(86): Xaa is any amino acid
  MISC_FEATURE (87)..(88): Xaa is A, C, G, P, M, V, I, L, Sce, or Sme
  MISC_FEATURE (89)..(89): Xaa is R, H, or K
  MISC_FEATURE (90)..(93): Xaa is A, C, G, P, M, V, I, L, Sce, or Sme
  MISC_FEATURE (94)..(94): Xaa is F, W, or Y
  MISC_FEATURE (95)..(96): Xaa is S, T, N, or Q
  MISC_FEATURE (97)..(97): Xaa is any amino acid
  MISC_FEATURE (98)..(98): Xaa is S, T, N, or Q
  MISC_FEATURE (99)..(99): Xaa is any amino acid
  MISC_FEATURE (100)..(100): Xaa is S, T, N, or Q
  MISC_FEATURE (101)..(102): Xaa is any amino acid
  MISC_FEATURE (103)..(103): Xaa is A, C, G, P, M, V, I, L, Sce, or Sme
  MISC_FEATURE (104)..(104): Xaa is any amino acid
  MISC_FEATURE (105)..(105): Xaa is R, H, or K
  MISC_FEATURE (106)..(106): Xaa is A, C, G, P, M, V, I, L, Sce, or Sme
  MISC_FEATURE (107)..(107): Xaa is F, W, or Y
  MISC_FEATURE (108)..(108): Xaa is A, C, G, P, M, V, I, L, Sce, or Sme
  MISC_FEATURE (110)..(110): Xaa is any amino acid
  MISC_FEATURE (111)..(111): Xaa is A, C, G, P, M, V, I, L, Sce, or Sme
  MISC_FEATURE (112)..(113): Xaa is any amino acid
  MISC_FEATURE (114)..(114): Xaa is A, C, G, P, M, V, I, L, Sce, or Sme
  MISC_FEATURE (115)..(115): Xaa is R, H, or K
  MISC_FEATURE (116)..(122): Xaa is any amino acid
XXXXXXXXIXXEEXTPAAXLAAXIEXXLKXXEXXXXXXXXXXXXXXXXXXXXXXXXXXXEAXXLIXXHXXXXXXXXXXXXXXXXXXXXXXXXXXXXXXXXXXXXXXXXNXXXXXXXXXXXXX

SEQ ID NO: 26 - protein, 177 aa, Artificial Sequence
  Synthetic
  MISC_FEATURE (1)..(1): Xaa is any amino acid or is optionally absent
  MISC_FEATURE (2)..(3): Xaa is any amino acid
  MISC_FEATURE (4)..(4): Xaa is A, C, G, P, M, V, I, L, Selenomethionine (Sme), or Selenocysteine (Sce)
  MISC_FEATURE (5)..(5): Xaa is R, H, or K
  MISC_FEATURE (6)..(9): Xaa is A, C, G, P, M, V, I, L, Sce or Sme
  MISC_FEATURE (10)..(10): Xaa is S, T, N or Q
  MISC_FEATURE (11)..(11): Xaa is A, C, G, P, M, V, I, L, Sce or Sme
  MISC_FEATURE (12)..(12): Xaa is S, T, N or Q
  MISC_FEATURE (13)..(13): Xaa is D or E
  MISC_FEATURE (14)..(14): Xaa is R, H, or K
  MISC_FEATURE (15)..(15): Xaa is A, C, G, P, M, V, I, L, Sce or Sme
  MISC_FEATURE (16)..(21): Xaa is any amino acid
  MISC_FEATURE (22)..(22): Xaa is D or E
  MISC_FEATURE (24)..(24): Xaa is S, T, N or Q
  MISC_FEATURE (25)..(25): Xaa is A, C, G, P, M, V, I, L, Sce or Sme
  MISC_FEATURE (28)..(29): Xaa is A, C, G, P, M, V, I, L, Sce or Sme
  MISC_FEATURE (32)..(32): Xaa is A, C, G, P, M, V, I, L, Sce or Sme
  MISC_FEATURE (36)..(36): Xaa is A, C, G, P, M, V, I, L, Sce or Sme
  MISC_FEATURE (37)..(37): Xaa is any amino acid
  MISC_FEATURE (38)..(38): Xaa is S, T, N or Q
  MISC_FEATURE (39)..(39): Xaa is any amino acid
  MISC_FEATURE (40)..(40): Xaa is F, W, or Y
  MISC_FEATURE (41)..(41): Xaa is D or E
  MISC_FEATURE (42)..(42): Xaa is any amino acid
  MISC_FEATURE (43)..(43): Xaa is A, C, G, P, M, V, I, L, Sce or Sme
  MISC_FEATURE (44)..(45): Xaa is any amino acid
  MISC_FEATURE (46)..(48): Xaa is A, C, G, P, M, V, I, L, Sce or Sme
  MISC_FEATURE (49)..(50): Xaa is D or E
  MISC_FEATURE (51)..(53): Xaa is any amino acid
  MISC_FEATURE (54)..(54): Xaa is A, C, G, P, M, V, I, L, Sce or Sme
  MISC_FEATURE (55)..(55): Xaa is D or E
  MISC_FEATURE (56)..(56): Xaa is any amino acid
  MISC_FEATURE (57)..(57): Xaa is S, T, N or Q
  MISC_FEATURE (58)..(58): Xaa is A, C, G, P, M, V, I, L, Sce or Sme
  MISC_FEATURE (59)..(59): Xaa is any amino acid
  MISC_FEATURE (60)..(60): Xaa is R, H, or K
  MISC_FEATURE (61)..(62): Xaa is A, C, G, P, M, V, I, L, Sce or Sme
  MISC_FEATURE (63)..(66): Xaa is any amino acid
  MISC_FEATURE (67)..(71): Xaa is A, C, G, P, M, V, I, L, Sce or Sme
  MISC_FEATURE (72)..(73): Xaa is S, T, N or Q
  MISC_FEATURE (74)..(75): Xaa is A, C, G, P, M, V, I, L, Sce or Sme
  MISC_FEATURE (76)..(76): Xaa is S, T, N or Q
  MISC_FEATURE (77)..(79): Xaa is A, C, G, P, M, V, I, L, Sce or Sme
  MISC_FEATURE (80)..(81): Xaa is any amino acid
  MISC_FEATURE (82)..(82): Xaa is D or E
  MISC_FEATURE (83)..(83): Xaa is A, C, G, P, M, V, I, L, Sce or Sme
  MISC_FEATURE (84)..(84): Xaa is S, T, N or Q
  MISC_FEATURE (85)..(85): Xaa is A, C, G, P, M, V, I, L, Sce or Sme
  MISC_FEATURE (86)..(86): Xaa is D or E
  MISC_FEATURE (87)..(87): Xaa is A, C, G, P, M, V, I, L, Sce or Sme
  MISC_FEATURE (88)..(88): Xaa is S, T, N or Q
  MISC_FEATURE (89)..(90): Xaa is any amino acid
  MISC_FEATURE (91)..(92): Xaa is A, C, G, P, M, V, I, L, Sce or Sme
  MISC_FEATURE (93)..(93): Xaa is any amino acid
  MISC_FEATURE (94)..(94): Xaa is R, H, or K
  MISC_FEATURE (95)..(95): Xaa is any amino acid
  MISC_FEATURE (96)..(98): Xaa is A, C, G, P, M, V, I, L, Sce or Sme
  MISC_FEATURE (99)..(99): Xaa is F, W, or Y
  MISC_FEATURE (100)..(100): Xaa is A, C, G, P, M, V, I, L, Sce or Sme
  MISC_FEATURE (101)..(101): Xaa is D or E
  MISC_FEATURE (102)..(103): Xaa is A, C, G, P, M, V, I, L, Sce or Sme
  MISC_FEATURE (104)..(104): Xaa is R, H, or K
  MISC_FEATURE (105)..(106): Xaa is any amino acid
  MISC_FEATURE (107)..(107): Xaa is S, T, N or Q
  MISC_FEATURE (108)..(110): Xaa is any amino acid
  MISC_FEATURE (111)..(112): Xaa is A, C, G, P, M, V, I, L, Sce or Sme
  MISC_FEATURE (113)..(113): Xaa is S, T, N or Q
  MISC_FEATURE (114)..(116): Xaa is A, C, G, P, M, V, I, L, Sce or Sme
  MISC_FEATURE (117)..(117): Xaa is S, T, N or Q
  MISC_FEATURE (118)..(118): Xaa is R, H, or K
  MISC_FEATURE (119)..(120): Xaa is S, T, N or Q
  MISC_FEATURE (121)..(123): Xaa is A, C, G, P, M, V, I, L, Sce or Sme
  MISC_FEATURE (124)..(124): Xaa is any amino acid
  MISC_FEATURE (125)..(125): Xaa is A, C, G, P, M, V, I, L, Sce or Sme
  MISC_FEATURE (126)..(126): Xaa is any amino acid
  MISC_FEATURE (127)..(127): Xaa is S, T, N or Q
  MISC_FEATURE (128)..(130): Xaa is A, C, G, P, M, V, I, L, Sce or Sme
  MISC_FEATURE (131)..(131): Xaa is S, T, N or Q
  MISC_FEATURE (132)..(134): Xaa is A, C, G, P, M, V, I, L, Sce or Sme
  MISC_FEATURE (135)..(135): Xaa is any amino acid
  MISC_FEATURE (136)..(136): Xaa is A, C, G, P, M, V, I, L, Sce or Sme
  MISC_FEATURE (139)..(139): Xaa is A, C, G, P, M, V, I, L, Sce or Sme
  MISC_FEATURE (142)..(143): Xaa is A, C, G, P, M, V, I, L, Sce or Sme
  MISC_FEATURE (145)..(146): Xaa is A, C, G, P, M, V, I, L, Sce or Sme
  MISC_FEATURE (147)..(147): Xaa is F, W, or Y
  MISC_FEATURE (148)..(151): Xaa is A, C, G, P, M, V, I, L, Sce or Sme
  MISC_FEATURE (152)..(152): Xaa is any amino acid
  MISC_FEATURE (153)..(154): Xaa is A, C, G, P, M, V, I, L, Sce or Sme
  MISC_FEATURE (155)..(155): Xaa is D or E
  MISC_FEATURE (156)..(156): Xaa is any amino acid
  MISC_FEATURE (157)..(157): Xaa is A, C, G, P, M, V, I, L, Sce or Sme
  MISC_FEATURE (158)..(158): Xaa is any amino acid
  MISC_FEATURE (159)..(160): Xaa is A, C, G, P, M, V, I, L, Sce or Sme
  MISC_FEATURE (161)..(161): Xaa is any amino acid
  MISC_FEATURE (162)..(162): Xaa is A, C, G, P, M, V, I, L, Sce or Sme
  MISC_FEATURE (163)..(163): Xaa is D or E
  MISC_FEATURE (164)..(164): Xaa is A, C, G, P, M, V, I, L, Sce or Sme
  MISC_FEATURE (165)..(166): Xaa is any amino acid
  MISC_FEATURE (169)..(169): Xaa is A, C, G, P, M, V, I, L, Sce or Sme
  MISC_FEATURE (170)..(170): Xaa is any amino acid
  MISC_FEATURE (171)..(171): Xaa is A, C, G, P, M, V, I, L, Sce or Sme
  MISC_FEATURE (172)..(172): Xaa is F, W, or Y
  MISC_FEATURE (173)..(177): Xaa is any amino acid
XXXXXXXXXXXXXXXXXXXXXXIXXKAXXLAXNLYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXASXSDXXLXXXXXXXXXXXXXXXXXXXXXXAMXXXXXXXXX

SEQ ID NO: 27 - protein, 122 aa, Artificial Sequence
  Synthetic
  MISC_FEATURE (1)..(1): Xaa is any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H, or K
  MISC_FEATURE (4)..(5): Xaa is A, C, G, P, M, V, I, L, Sce, or Sme
  MISC_FEATURE (6)..(6): Xaa is R, H, or K
  MISC_FEATURE (7)..(9): Xaa is A, C, G, P, M, V, I, L, Sce, or Sme
  MISC_FEATURE (10)..(10): Xaa is S, T, N, or Q
  MISC_FEATURE (11)..(11): Xaa is A, C, G, P, M, V, I, L, Sce, or Sme
  MISC_FEATURE (14)..(14): Xaa is any amino acid
  MISC_FEATURE (19)..(19): Xaa is A, C, G, P, M, V, I, L, Sce, or Sme
  MISC_FEATURE (22)..(22): Xaa is A, C, G, P, M, V, I, L, Sce, or Sme
  MISC_FEATURE (23)..(23): Xaa is S, T, N, or Q
  MISC_FEATURE (26)..(27): Xaa is A, C, G, P, M, V, I, L, Sce, or Sme
  MISC_FEATURE (29)..(29): Xaa is R, H, or K
  MISC_FEATURE (30)..(31): Xaa is A, C, G, P, M, V, I, L, Sce, or Sme
  MISC_FEATURE (32)..(33): Xaa is any amino acid
  MISC_FEATURE (34)..(34): Xaa is S, T, N, or Q
  MISC_FEATURE (35)..(35): Xaa is any amino acid
  MISC_FEATURE (36)..(36): Xaa is A, C, G, P, M, V, I, L, Sce, or Sme
  MISC_FEATURE (37)..(37): Xaa is any amino acid
  MISC_FEATURE (38)..(38): Xaa is S, T, N, or Q
  MISC_FEATURE (39)..(39): Xaa is any amino acid
  MISC_FEATURE (40)..(40): Xaa is D or E
  MISC_FEATURE (41)..(41): Xaa is any amino acid
  MISC_FEATURE (42)..(46): Xaa is A, C, G, P, M, V, I, L, Sce, or Sme
  MISC_FEATURE (47)..(47): Xaa is F, W, or Y
  MISC_FEATURE (48)..(48): Xaa is S, T, N, or Q
  MISC_FEATURE (49)..(49): Xaa is A, C, G, P, M, V, I, L, Sce, or Sme
  MISC_FEATURE (50)..(50): Xaa is S, T, N, or Q
  MISC_FEATURE (51)..(52): Xaa is any amino acid
  MISC_FEATURE (53)..(53): Xaa is A, C, G, P, M, V, I, L, Sce, or Sme
  MISC_FEATURE (54)..(55): Xaa is S, T, N, or Q
  MISC_FEATURE (56)..(56): Xaa is A, C, G, P, M, V, I, L, Sce, or Sme
  MISC_FEATURE (57)..(57): Xaa is any amino acid
  MISC_FEATURE (58)..(59): Xaa is A, C, G, P, M, V, I, L, Sce, or Sme
  MISC_FEATURE (60)..(60): Xaa is D or E
  MISC_FEATURE (61)..(62): Xaa is A, C, G, P, M, V, I, L, Sce, or Sme
  MISC_FEATURE (63)..(63): Xaa is R, H, or K
  MISC_FEATURE (65)..(67): Xaa is A, C, G, P, M, V, I, L, Sce, or Sme
  MISC_FEATURE (68)..(68): Xaa is any amino acid
  MISC_FEATURE (69)..(69): Xaa is R, H, or K
  MISC_FEATURE (70)..(73): Xaa is A, C, G, P, M, V, I, L, Sce, or Sme
  MISC_FEATURE (74)..(74): Xaa is S, T, N, or Q
  MISC_FEATURE (75)..(75): Xaa is A, C, G, P, M, V, I, L, Sce, or Sme
  MISC_FEATURE (76)..(76): Xaa is R, H, or K
  MISC_FEATURE (77)..(77): Xaa is D or E
  MISC_FEATURE (78)..(78): Xaa is A, C, G, P, M, V, I, L, Sce, or Sme
  MISC_FEATURE (79)..(79): Xaa is any amino acid
  MISC_FEATURE (80)..(80): Xaa is A, C, G, P, M, V, I, L, Sce, or Sme
  MISC_FEATURE (81)..(82): Xaa is any amino acid
  MISC_FEATURE (83)..(83): Xaa is S, T, N, or Q
  MISC_FEATURE (84)..(84): Xaa is A, C, G, P, M, V, I, L, Sce, or Sme
  MISC_FEATURE (85)..(86): Xaa is any amino acid
  MISC_FEATURE (87)..(88): Xaa is A, C, G, P, M, V, I, L, Sce, or Sme
  MISC_FEATURE (89)..(89): Xaa is R, H, or K
  MISC_FEATURE (90)..(93): Xaa is A, C, G, P, M, V, I, L, Sce, or Sme
  MISC_FEATURE (94)..(94): Xaa is F, W, or Y
  MISC_FEATURE (95)..(96): Xaa is S, T, N, or Q
  MISC_FEATURE (97)..(97): Xaa is any amino acid
  MISC_FEATURE (98)..(98): Xaa is S, T, N, or Q
  MISC_FEATURE (99)..(99): Xaa is any amino acid
  MISC_FEATURE (100)..(100): Xaa is S, T, N, or Q
  MISC_FEATURE (101)..(102): Xaa is any amino acid
  MISC_FEATURE (103)..(103): Xaa is A, C, G, P, M, V, I, L, Sce, or Sme
  MISC_FEATURE (104)..(105): Xaa is any amino acid
  MISC_FEATURE (106)..(106): Xaa is A, C, G, P, M, V, I, L, Sce, or Sme
  MISC_FEATURE (107)..(107): Xaa is any amino acid
  MISC_FEATURE (108)..(108): Xaa is A, C, G, P, M, V, I, L, Sce, or Sme
  MISC_FEATURE (110)..(110): Xaa is D or E
  MISC_FEATURE (111)..(111): Xaa is A, C, G, P, M, V, I, L, Sce, or Sme
  MISC_FEATURE (112)..(122): Xaa is any amino acid
XXXXXXXXXXXNSXTPTDXIIXXILXXEXXXXXXXXXXXXXXXXXXXXXXXXXXXXXXXXXXXQXXXXXXXXXXXXXXXXXXXXXXXXXXXXXXXXXXXXXXXXXXXXSXXXXXXXXXXXXX

SEQ ID NO: 28 - protein, 172 aa, Artificial Sequence
  Synthetic
  MISC_FEATURE (1)..(1): Xaa is any amino acid or optionally absent
  MISC_FEATURE (2)..(22): Xaa is any amino acid
  MISC_FEATURE (24)..(25): Xaa is any amino acid
  MISC_FEATURE (26)..(27): Xaa is A, C, G, P, M, V, I, L, Selenomethionine (Sme), or Selenocysteine (Sce)
  MISC_FEATURE (28)..(29): Xaa is any amino acid
  MISC_FEATURE (30)..(30): Xaa is A, C, G, P, M, V, I, L, Sce or Sme
  MISC_FEATURE (31)..(31): Xaa is S, T, N,  or Q
  MISC_FEATURE (32)..(32): Xaa is A, C, G, P, M, V, I, L, Sce or Sme
  MISC_FEATURE (33)..(33): Xaa is S, T, N,  or Q
  MISC_FEATURE (34)..(34): Xaa is A, C, G, P, M, V, I, L, Sce or Sme
  MISC_FEATURE (35)..(36): Xaa is D or E
  MISC_FEATURE (37)..(37): Xaa is A, C, G, P, M, V, I, L, Sce or Sme
  MISC_FEATURE (38)..(39): Xaa is S, T, N,  or Q
  MISC_FEATURE (40)..(40): Xaa is F, W, or Y
  MISC_FEATURE (41)..(42): Xaa is A, C, G, P, M, V, I, L, Sce or Sme
  MISC_FEATURE (43)..(43): Xaa is D or E
  MISC_FEATURE (44)..(44): Xaa is A, C, G, P, M, V, I, L, Sce or Sme
  MISC_FEATURE (45)..(45): Xaa is R, H, or K
  MISC_FEATURE (46)..(46): Xaa is any amino acid
  MISC_FEATURE (47)..(47): Xaa is F, W, or Y
  MISC_FEATURE (48)..(48): Xaa is A, C, G, P, M, V, I, L, Sce or Sme
  MISC_FEATURE (49)..(51): Xaa is any amino acid
  MISC_FEATURE (52)..(52): Xaa is A, C, G, P, M, V, I, L, Sce or Sme
  MISC_FEATURE (53)..(53): Xaa is any amino acid
  MISC_FEATURE (54)..(56): Xaa is A, C, G, P, M, V, I, L, Sce or Sme
  MISC_FEATURE (57)..(57): Xaa is D or E
  MISC_FEATURE (58)..(58): Xaa is any amino acid
  MISC_FEATURE (59)..(59): Xaa is A, C, G, P, M, V, I, L, Sce or Sme
  MISC_FEATURE (60)..(61): Xaa is S, T, N,  or Q
  MISC_FEATURE (62)..(62): Xaa is D or E
  MISC_FEATURE (63)..(63): Xaa is A, C, G, P, M, V, I, L, Sce or Sme
  MISC_FEATURE (64)..(64): Xaa is any amino acid
  MISC_FEATURE (65)..(65): Xaa is R, H, or K
  MISC_FEATURE (66)..(68): Xaa is A, C, G, P, M, V, I, L, Sce or Sme
  MISC_FEATURE (69)..(69): Xaa is D or E
  MISC_FEATURE (70)..(71): Xaa is A, C, G, P, M, V, I, L, Sce or Sme
  MISC_FEATURE (72)..(72): Xaa is S, T, N,  or Q
  MISC_FEATURE (73)..(73): Xaa is any amino acid
  MISC_FEATURE (74)..(74): Xaa is A, C, G, P, M, V, I, L, Sce or Sme
  MISC_FEATURE (75)..(77): Xaa is any amino acid
  MISC_FEATURE (78)..(79): Xaa is A, C, G, P, M, V, I, L, Sce or Sme
  MISC_FEATURE (80)..(80): Xaa is any amino acid
  MISC_FEATURE (82)..(83): Xaa is any amino acid
  MISC_FEATURE (86)..(86): Xaa is F, W, or Y
  MISC_FEATURE (87)..(87): Xaa is A, C, G, P, M, V, I, L, Sce or Sme
  MISC_FEATURE (89)..(89): Xaa is any amino acid
  MISC_FEATURE (90)..(90): Xaa is A, C, G, P, M, V, I, L, Sce or Sme
  MISC_FEATURE (93)..(93): Xaa is any amino acid
  MISC_FEATURE (94)..(94): Xaa is F, W, or Y
  MISC_FEATURE (96)..(97): Xaa is any amino acid
  MISC_FEATURE (98)..(98): Xaa is A, C, G, P, M, V, I, L, Sce or Sme
  MISC_FEATURE (99)..(104): Xaa is any amino acid
  MISC_FEATURE (105)..(108): Xaa is A, C, G, P, M, V, I, L, Sce or Sme
  MISC_FEATURE (109)..(109): Xaa is S, T, N,  or Q
  MISC_FEATURE (110)..(110): Xaa is A, C, G, P, M, V, I, L, Sce or Sme
  MISC_FEATURE (111)..(111): Xaa is any amino acid
  MISC_FEATURE (112)..(112): Xaa is S, T, N,  or Q
  MISC_FEATURE (113)..(113): Xaa is A, C, G, P, M, V, I, L, Sce or Sme
  MISC_FEATURE (114)..(114): Xaa is R, H, or K
  MISC_FEATURE (115)..(115): Xaa is A, C, G, P, M, V, I, L, Sce or Sme
  MISC_FEATURE (116)..(116): Xaa is D or E
  MISC_FEATURE (117)..(118): Xaa is A, C, G, P, M, V, I, L, Sce or Sme
  MISC_FEATURE (119)..(119): Xaa is R, H, or K
  MISC_FEATURE (120)..(120): Xaa is S, T, N,  or Q
  MISC_FEATURE (121)..(122): Xaa is A, C, G, P, M, V, I, L, Sce or Sme
  MISC_FEATURE (123)..(123): Xaa is any amino acid
  MISC_FEATURE (124)..(124): Xaa is R, H, or K
  MISC_FEATURE (125)..(125): Xaa is A, C, G, P, M, V, I, L, Sce or Sme
  MISC_FEATURE (127)..(128): Xaa is R, H, or K
  MISC_FEATURE (129)..(129): Xaa is A, C, G, P, M, V, I, L, Sce or Sme
  MISC_FEATURE (131)..(131): Xaa is any amino acid
  MISC_FEATURE (132)..(132): Xaa is A, C, G, P, M, V, I, L, Sce or Sme
  MISC_FEATURE (135)..(136): Xaa is any amino acid
  MISC_FEATURE (139)..(139): Xaa is A, C, G, P, M, V, I, L, Sce or Sme
  MISC_FEATURE (142)..(142): Xaa is A, C, G, P, M, V, I, L, Sce or Sme
  MISC_FEATURE (145)..(145): Xaa is F, W, or Y
  MISC_FEATURE (146)..(146): Xaa is A, C, G, P, M, V, I, L, Sce or Sme
  MISC_FEATURE (149)..(149): Xaa is A, C, G, P, M, V, I, L, Sce or Sme
  MISC_FEATURE (150)..(150): Xaa is S, T, N,  or Q
  MISC_FEATURE (152)..(153): Xaa is A, C, G, P, M, V, I, L, Sce or Sme
  MISC_FEATURE (154)..(154): Xaa is any amino acid
  MISC_FEATURE (155)..(157): Xaa is A, C, G, P, M, V, I, L, Sce or Sme
  MISC_FEATURE (158)..(158): Xaa is R, H, or K
  MISC_FEATURE (159)..(160): Xaa is A, C, G, P, M, V, I, L, Sce or Sme
  MISC_FEATURE (161)..(161): Xaa is D or E
  MISC_FEATURE (162)..(172): Xaa is any amino acid
XXXXXXXXXXXXXXXXXXXXXXKXXXXXXXXXXXXXXXXXXXXXXXXXXXXXXXXXXXXXXXXXXXXXXXXXXXXXXXXXEXXIAXXLXXILXXMXXXXXXXXXXXXXXXXXXXXXXXXXXXXXXLXXXLXXTRXXGIXAEXAAXXLAXXDXXXXXXXXXXXXXXXXXXXXX

SEQ ID NO: 29 - protein, 123 aa, Artificial Sequence
  Synthetic
  MISC_FEATURE (1)..(1): Xaa ia any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H, or K
  MISC_FEATURE (4)..(6): Xaa is A, C, G, P, M, V, I, L, Sce or Sme
  MISC_FEATURE (7)..(7): Xaa is D or E
  MISC_FEATURE (8)..(8): Xaa is A, C, G, P, M, V, I, L, Sce or Sme
  MISC_FEATURE (9)..(9): Xaa is S, T, N or Q
  MISC_FEATURE (10)..(10): Xaa is A, C, G, P, M, V, I, L, Sce or Sme
  MISC_FEATURE (11)..(11): Xaa is S, T, N or Q
  MISC_FEATURE (12)..(12): Xaa is A, C, G, P, M, V, I, L, Sce or Sme
  MISC_FEATURE (13)..(13): Xaa ia any amino acid
  MISC_FEATURE (14)..(14): Xaa is A, C, G, P, M, V, I, L, Sce or Sme
  MISC_FEATURE (15)..(15): Xaa ia any amino acid
  MISC_FEATURE (16)..(16): Xaa is S, T, N or Q
  MISC_FEATURE (17)..(17): Xaa ia any amino acid
  MISC_FEATURE (18)..(19): Xaa is A, C, G, P, M, V, I, L, Sce or Sme
  MISC_FEATURE (20)..(20): Xaa ia any amino acid
  MISC_FEATURE (21)..(22): Xaa is A, C, G, P, M, V, I, L, Sce or Sme
  MISC_FEATURE (23)..(23): Xaa is D or E
  MISC_FEATURE (24)..(24): Xaa ia any amino acid
  MISC_FEATURE (25)..(25): Xaa is A, C, G, P, M, V, I, L, Sce or Sme
  MISC_FEATURE (26)..(26): Xaa is S, T, N or Q
  MISC_FEATURE (29)..(29): Xaa is A, C, G, P, M, V, I, L, Sce or Sme
  MISC_FEATURE (33)..(33): Xaa ia any amino acid
  MISC_FEATURE (35)..(35): Xaa is F, W, or Y
  MISC_FEATURE (36)..(36): Xaa is A, C, G, P, M, V, I, L, Sce or Sme
  MISC_FEATURE (37)..(37): Xaa is D or E
  MISC_FEATURE (38)..(38): Xaa is A, C, G, P, M, V, I, L, Sce or Sme
  MISC_FEATURE (39)..(39): Xaa ia any amino acid
  MISC_FEATURE (40)..(40): Xaa is A, C, G, P, M, V, I, L, Sce or Sme
  MISC_FEATURE (41)..(41): Xaa is R, H, or K
  MISC_FEATURE (42)..(43): Xaa ia any amino acid
  MISC_FEATURE (44)..(44): Xaa is F, W, or Y
  MISC_FEATURE (45)..(45): Xaa is A, C, G, P, M, V, I, L, Sce or Sme
  MISC_FEATURE (46)..(46): Xaa ia any amino acid
  MISC_FEATURE (47)..(47): Xaa is A, C, G, P, M, V, I, L, Sce or Sme
  MISC_FEATURE (48)..(48): Xaa ia any amino acid
  MISC_FEATURE (49)..(49): Xaa is A, C, G, P, M, V, I, L, Sce or Sme
  MISC_FEATURE (50)..(50): Xaa is F, W, or Y
  MISC_FEATURE (51)..(51): Xaa ia any amino acid
  MISC_FEATURE (52)..(52): Xaa is S, T, N or Q
  MISC_FEATURE (53)..(53): Xaa is A, C, G, P, M, V, I, L, Sce or Sme
  MISC_FEATURE (54)..(54): Xaa ia any amino acid
  MISC_FEATURE (55)..(55): Xaa is A, C, G, P, M, V, I, L, Sce or Sme
  MISC_FEATURE (56)..(58): Xaa ia any amino acid
  MISC_FEATURE (59)..(59): Xaa is R, H, or K
  MISC_FEATURE (60)..(60): Xaa ia any amino acid
  MISC_FEATURE (61)..(61): Xaa is F, W, or Y
  MISC_FEATURE (62)..(62): Xaa ia any amino acid
  MISC_FEATURE (63)..(63): Xaa is R, H, or K
  MISC_FEATURE (64)..(66): Xaa ia any amino acid
  MISC_FEATURE (67)..(67): Xaa is S, T, N or Q
  MISC_FEATURE (68)..(69): Xaa ia any amino acid
  MISC_FEATURE (70)..(70): Xaa ia any amino acid
  MISC_FEATURE (72)..(72): Xaa ia any amino acid
  MISC_FEATURE (77)..(77): Xaa is R, H, or K
  MISC_FEATURE (80)..(81): Xaa ia any amino acid
  MISC_FEATURE (84)..(84): Xaa ia any amino acid
  MISC_FEATURE (87)..(89): Xaa ia any amino acid
  MISC_FEATURE (90)..(90): Xaa ia any amino acid
  MISC_FEATURE (91)..(96): Xaa ia any amino acid
  MISC_FEATURE (97)..(98): Xaa ia any amino acid
  MISC_FEATURE (99)..(100): Xaa ia any amino acid
  MISC_FEATURE (101)..(101): Xaa is S, T, N or Q
  MISC_FEATURE (102)..(102): Xaa ia any amino acid
  MISC_FEATURE (103)..(103): Xaa is S, T, N or Q
  MISC_FEATURE (104)..(104): Xaa ia any amino acid
  MISC_FEATURE (105)..(105): Xaa is D or E
  MISC_FEATURE (106)..(106): Xaa ia any amino acid
  MISC_FEATURE (107)..(107): Xaa is R, H, or K
  MISC_FEATURE (108)..(108): Xaa ia any amino acid
  MISC_FEATURE (109)..(109): Xaa ia any amino acid
  MISC_FEATURE (110)..(110): Xaa is D or E
  MISC_FEATURE (111)..(111): Xaa ia any amino acid
  MISC_FEATURE (113)..(113): Xaa is S, T, N or Q
  MISC_FEATURE (118)..(123): Xaa ia any amino acid
XXXXXXXXXXXXXXXXXXXXXXXXXXKAXFASXQXXXXXXXXXXXXXXXXXXXXXXXXXXXXXXXXXXXXGXDIATXTLXXASXCAXXXXXXXXXXXXXXXXXXXXXXXXXLXYAKRXXXXXX

SEQ ID NO: 30 - protein, 158 aa, Artificial Sequence
  Synthetic
  MISC_FEATURE (1)..(1): Xaa is any amino acid or is optionally absent
  MISC_FEATURE (2)..(4): Xaa is any amino acid
  MISC_FEATURE (5)..(7): Xaa is S, T, N or Q
  MISC_FEATURE (8)..(8): Xaa is F, W, or Y
  MISC_FEATURE (9)..(9): Xaa is A, C, G, P, M, V, I, L, Selenomethionine (Sme), or Selenocysteine (Sce)
  MISC_FEATURE (10)..(10): Xaa is S, T, N or Q
  MISC_FEATURE (11)..(11): Xaa is A, C, G, P, M, V, I, L, Sce or Sme
  MISC_FEATURE (12)..(12): Xaa is S, T, N or Q
  MISC_FEATURE (13)..(14): Xaa is A, C, G, P, M, V, I, L, Sce or Sme
  MISC_FEATURE (15)..(15): Xaa is S, T, N or Q
  MISC_FEATURE (16)..(16): Xaa is A, C, G, P, M, V, I, L, Sce or Sme
  MISC_FEATURE (17)..(17): Xaa is R, H, or K
  MISC_FEATURE (18)..(18): Xaa is D or E
  MISC_FEATURE (19)..(21): Xaa is any amino acid
  MISC_FEATURE (22)..(22): Xaa is A, C, G, P, M, V, I, L, Sce or Sme
  MISC_FEATURE (23)..(23): Xaa is S, T, N or Q
  MISC_FEATURE (24)..(24): Xaa is F, W, or Y
  MISC_FEATURE (25)..(27): Xaa is A, C, G, P, M, V, I, L, Sce or Sme
  MISC_FEATURE (28)..(28): Xaa is R, H, or K
  MISC_FEATURE (29)..(29): Xaa is A, C, G, P, M, V, I, L, Sce or Sme
  MISC_FEATURE (30)..(31): Xaa is any amino acid
  MISC_FEATURE (32)..(32): Xaa is S, T, N or Q
  MISC_FEATURE (33)..(33): Xaa is A, C, G, P, M, V, I, L, Sce or Sme
  MISC_FEATURE (34)..(34): Xaa is F, W, or Y
  MISC_FEATURE (35)..(36): Xaa is A, C, G, P, M, V, I, L, Sce or Sme
  MISC_FEATURE (37)..(37): Xaa is D or E
  MISC_FEATURE (38)..(38): Xaa is any amino acid
  MISC_FEATURE (39)..(39): Xaa is A, C, G, P, M, V, I, L, Sce or Sme
  MISC_FEATURE (40)..(40): Xaa is D or E
  MISC_FEATURE (41)..(41): Xaa is A, C, G, P, M, V, I, L, Sce or Sme
  MISC_FEATURE (42)..(42): Xaa is D or E
  MISC_FEATURE (43)..(44): Xaa is A, C, G, P, M, V, I, L, Sce or Sme
  MISC_FEATURE (45)..(46): Xaa is any amino acid
  MISC_FEATURE (47)..(47): Xaa is R, H, or K
  MISC_FEATURE (48)..(48): Xaa is A, C, G, P, M, V, I, L, Sce or Sme
  MISC_FEATURE (51)..(51): Xaa is A, C, G, P, M, V, I, L, Sce or Sme
  MISC_FEATURE (55)..(55): Xaa is S, T, N or Q
  MISC_FEATURE (58)..(59): Xaa is A, C, G, P, M, V, I, L, Sce or Sme
  MISC_FEATURE (61)..(61): Xaa is D or E
  MISC_FEATURE (62)..(65): Xaa is any amino acid
  MISC_FEATURE (66)..(66): Xaa is F, W, or Y
  MISC_FEATURE (67)..(67): Xaa is any amino acid
  MISC_FEATURE (68)..(69): Xaa is A, C, G, P, M, V, I, L, Sce or Sme
  MISC_FEATURE (70)..(70): Xaa is R, H, or K
  MISC_FEATURE (71)..(71): Xaa is A, C, G, P, M, V, I, L, Sce or Sme
  MISC_FEATURE (72)..(72): Xaa is R, H, or K
  MISC_FEATURE (73)..(73): Xaa is A, C, G, P, M, V, I, L, Sce or Sme
  MISC_FEATURE (74)..(74): Xaa is R, H, or K
  MISC_FEATURE (75)..(76): Xaa is A, C, G, P, M, V, I, L, Sce or Sme
  MISC_FEATURE (77)..(77): Xaa is D or E
  MISC_FEATURE (78)..(78): Xaa is A, C, G, P, M, V, I, L, Sce or Sme
  MISC_FEATURE (79)..(79): Xaa is any amino acid
  MISC_FEATURE (80)..(80): Xaa is D or E
  MISC_FEATURE (81)..(81): Xaa is R, H, or K
  MISC_FEATURE (82)..(84): Xaa is any amino acid
  MISC_FEATURE (85)..(85): Xaa is S, T, N or Q
  MISC_FEATURE (86)..(86): Xaa is A, C, G, P, M, V, I, L, Sce or Sme
  MISC_FEATURE (87)..(87): Xaa is any amino acid
  MISC_FEATURE (88)..(88): Xaa is A, C, G, P, M, V, I, L, Sce or Sme
  MISC_FEATURE (89)..(89): Xaa is any amino acid
  MISC_FEATURE (90)..(90): Xaa is A, C, G, P, M, V, I, L, Sce or Sme
  MISC_FEATURE (91)..(91): Xaa is D or E
  MISC_FEATURE (92)..(93): Xaa is A, C, G, P, M, V, I, L, Sce or Sme
  MISC_FEATURE (94)..(105): Xaa is any amino acid
  MISC_FEATURE (106)..(106): Xaa is A, C, G, P, M, V, I, L, Sce or Sme
  MISC_FEATURE (107)..(108): Xaa is D or E
  MISC_FEATURE (109)..(109): Xaa is any amino acid
  MISC_FEATURE (110)..(110): Xaa is A, C, G, P, M, V, I, L, Sce or Sme
  MISC_FEATURE (111)..(111): Xaa is R, H, or K
  MISC_FEATURE (114)..(114): Xaa is A, C, G, P, M, V, I, L, Sce or Sme
  MISC_FEATURE (115)..(115): Xaa is any amino acid
  MISC_FEATURE (118)..(118): Xaa is A, C, G, P, M, V, I, L, Sce or Sme
  MISC_FEATURE (120)..(120): Xaa is A, C, G, P, M, V, I, L, Sce or Sme
  MISC_FEATURE (121)..(121): Xaa is any amino acid
  MISC_FEATURE (122)..(122): Xaa is A, C, G, P, M, V, I, L, Sce or Sme
  MISC_FEATURE (123)..(123): Xaa is any amino acid
  MISC_FEATURE (124)..(124): Xaa is D or E
  MISC_FEATURE (125)..(127): Xaa is any amino acid
  MISC_FEATURE (128)..(129): Xaa is A, C, G, P, M, V, I, L, Sce or Sme
  MISC_FEATURE (130)..(131): Xaa is S, T, N or Q
  MISC_FEATURE (132)..(132): Xaa is F, W, or Y
  MISC_FEATURE (133)..(134): Xaa is any amino acid
  MISC_FEATURE (135)..(135): Xaa is R, H, or K
  MISC_FEATURE (136)..(142): Xaa is any amino acid
  MISC_FEATURE (143)..(143): Xaa is S, T, N or Q
  MISC_FEATURE (144)..(144): Xaa is D or E
  MISC_FEATURE (145)..(145): Xaa is any amino acid
  MISC_FEATURE (146)..(146): Xaa is F, W, or Y
  MISC_FEATURE (147)..(147): Xaa is any amino acid
  MISC_FEATURE (148)..(148): Xaa is A, C, G, P, M, V, I, L, Sce or Sme
  MISC_FEATURE (149)..(149): Xaa is D or E
  MISC_FEATURE (150)..(150): Xaa is R, H, or K
  MISC_FEATURE (151)..(152): Xaa is any amino acid
  MISC_FEATURE (153)..(154): Xaa is F, W, or Y
  MISC_FEATURE (155)..(158): Xaa is any amino acid
XXXXXXXXXXXXXXXXXXXXXXXXXXXXXXXXXXXXXXXXXXXXXXXXIGXRAAXIFXXDXXXXXXXXXXXXXXXXXXXXXXXXXXXXXXXXXXXXXXXXXXXXXXXXXXXLAXXVAXQXXXXXXXXXXXXXXXXXXXXXXXXXXXXXXXXXXXXXXX

SEQ ID NO: 31 - protein, 113 aa, Artificial Sequence
  Synthetic
  MISC_FEATURE (1)..(1): Xaa is any amino acid or is optionally absent
  MISC_FEATURE (2)..(4): Xaa is A, C, G, P, M, V, I, L, Selenomethionine (Sme), or Selenocysteine (Sce)
  MISC_FEATURE (5)..(6): Xaa is S, T, N, or Q
  MISC_FEATURE (7)..(7): Xaa is F, W, or Y
  MISC_FEATURE (8)..(8): Xaa is A, C, G, P, M, V, I, L, Sce, Sme
  MISC_FEATURE (9)..(10): Xaa is S, T, N, or Q
  MISC_FEATURE (11)..(11): Xaa is any amino acid
  MISC_FEATURE (12)..(12): Xaa is A, C, G, P, M, V, I, L, Sce, Sme
  MISC_FEATURE (13)..(14): Xaa is any amino acid
  MISC_FEATURE (16)..(17): Xaa is any amino acid
  MISC_FEATURE (20)..(21): Xaa is A, C, G, P, M, V, I, L, Sce, Sme
  MISC_FEATURE (24)..(24): Xaa is F, W, or Y
  MISC_FEATURE (28)..(28): Xaa is S, T, N, or Q
  MISC_FEATURE (32)..(32): Xaa is A, C, G, P, M, V, I, L, Sce, Sme
  MISC_FEATURE (33)..(33): Xaa is any amino acid
  MISC_FEATURE (34)..(34): Xaa is R, H, or K
  MISC_FEATURE (35)..(35): Xaa is any amino acid
  MISC_FEATURE (37)..(37): Xaa is D or E
  MISC_FEATURE (38)..(41): Xaa is A, C, G, P, M, V, I, L, Sce, Sme
  MISC_FEATURE (42)..(42): Xaa is S, T, N, or Q
  MISC_FEATURE (43)..(43): Xaa is F, W, or Y
  MISC_FEATURE (44)..(44): Xaa is R, H, or K
  MISC_FEATURE (45)..(46): Xaa is any amino acid
  MISC_FEATURE (47)..(47): Xaa is S, T, N, or Q
  MISC_FEATURE (48)..(49): Xaa is A, C, G, P, M, V, I, L, Sce, Sme
  MISC_FEATURE (50)..(50): Xaa is R, H, or K
  MISC_FEATURE (51)..(52): Xaa is F, W, or Y
  MISC_FEATURE (53)..(53): Xaa is A, C, G, P, M, V, I, L, Sce, Sme
  MISC_FEATURE (54)..(54): Xaa is S, T, N, or Q
  MISC_FEATURE (55)..(57): Xaa is any amino acid
  MISC_FEATURE (58)..(61): Xaa is A, C, G, P, M, V, I, L, Sce, Sme
  MISC_FEATURE (62)..(62): Xaa is R, H, or K
  MISC_FEATURE (63)..(63): Xaa is A, C, G, P, M, V, I, L, Sce, Sme
  MISC_FEATURE (64)..(64): Xaa is D or E
  MISC_FEATURE (65)..(65): Xaa is A, C, G, P, M, V, I, L, Sce, Sme
  MISC_FEATURE (66)..(67): Xaa is any amino acid
  MISC_FEATURE (68)..(68): Xaa is A, C, G, P, M, V, I, L, Sce, Sme
  MISC_FEATURE (69)..(69): Xaa is any amino acid
  MISC_FEATURE (70)..(70): Xaa is A, C, G, P, M, V, I, L, Sce, Sme
  MISC_FEATURE (71)..(72): Xaa is any amino acid
  MISC_FEATURE (73)..(73): Xaa is D or E
  MISC_FEATURE (74)..(74): Xaa is A, C, G, P, M, V, I, L, Sce, Sme
  MISC_FEATURE (75)..(75): Xaa is any amino acid
  MISC_FEATURE (76)..(76): Xaa is R, H, or K
  MISC_FEATURE (77)..(77): Xaa is A, C, G, P, M, V, I, L, Sce, Sme
  MISC_FEATURE (78)..(79): Xaa is S, T, N, or Q
  MISC_FEATURE (81)..(81): Xaa is A, C, G, P, M, V, I, L, Sce, Sme
  MISC_FEATURE (82)..(82): Xaa is S, T, N, or Q
  MISC_FEATURE (85)..(85): Xaa is A, C, G, P, M, V, I, L, Sce, Sme
  MISC_FEATURE (89)..(89): Xaa is A, C, G, P, M, V, I, L, Sce, Sme
  MISC_FEATURE (90)..(90): Xaa is any amino acid
  MISC_FEATURE (91)..(91): Xaa is A, C, G, P, M, V, I, L, Sce, Sme
  MISC_FEATURE (92)..(92): Xaa is any amino acid
  MISC_FEATURE (93)..(93): Xaa is A, C, G, P, M, V, I, L, Sce, Sme
  MISC_FEATURE (94)..(94): Xaa is any amino acid
  MISC_FEATURE (95)..(95): Xaa is R, H, or K
  MISC_FEATURE (96)..(96): Xaa is A, C, G, P, M, V, I, L, Sce, Sme
  MISC_FEATURE (97)..(97): Xaa is F, W, or Y
  MISC_FEATURE (98)..(99): Xaa is A, C, G, P, M, V, I, L, Sce, Sme
  MISC_FEATURE (100)..(101): Xaa is F, W, or Y
  MISC_FEATURE (102)..(102): Xaa is any amino acid
  MISC_FEATURE (103)..(103): Xaa is A, C, G, P, M, V, I, L, Sce, Sme
  MISC_FEATURE (104)..(104): Xaa is any amino acid
  MISC_FEATURE (105)..(105): Xaa is R, H, or K
  MISC_FEATURE (106)..(107): Xaa is A, C, G, P, M, V, I, L, Sce, Sme
  MISC_FEATURE (108)..(108): Xaa is any amino acid
  MISC_FEATURE (109)..(109): Xaa is S, T, N, or Q
  MISC_FEATURE (110)..(110): Xaa is A, C, G, P, M, V, I, L, Sce, Sme
  MISC_FEATURE (111)..(113): Xaa is any amino acid
XXXXXXXXXXXXXXHXXLLXXIIXRIVXRVVXXXXEXXXXXXXXXXXXXXXXXXXXXXXXXXXXXXXXXXXXXXXXXXXIXXAAXTAVXXXXXXXXXXXXXXXXXXXXXXXXX

SEQ ID NO: 32 - protein, 159 aa, Artificial Sequence; identical to SEQ ID NO: 22
  Synthetic
  MISC_FEATURE (1)..(1): Xaa is any amino acid or optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is D or E
  MISC_FEATURE (4)..(7): Xaa is A, C, G, P, M, V, I, L, Sme, or Sce
  MISC_FEATURE (8)..(8): Xaa is D or E
  MISC_FEATURE (9)..(9): Xaa is A, C, G, P, M, V, I, L, Sme, or Sce
  MISC_FEATURE (10)..(10): Xaa is R, H or K
  MISC_FEATURE (11)..(11): Xaa is D or E
  MISC_FEATURE (12)..(12): Xaa is A, C, G, P, M, V, I, L, Sme, or Sce
  MISC_FEATURE (13)..(13): Xaa is S, T, N, or Q
  MISC_FEATURE (14)..(15): Xaa is A, C, G, P, M, V, I, L, Sme, or Sce
  MISC_FEATURE (16)..(16): Xaa is D or E
  MISC_FEATURE (17)..(20): Xaa is A, C, G, P, M, V, I, L, Sme, or Sce
  MISC_FEATURE (21)..(21): Xaa is F, W or Y
  MISC_FEATURE (22)..(22): Xaa is A, C, G, P, M, V, I, L, Sme, or Sce
  MISC_FEATURE (23)..(23): Xaa is S, T, N, or Q
  MISC_FEATURE (24)..(25): Xaa is A, C, G, P, M, V, I, L, Sme, or Sce
  MISC_FEATURE (26)..(26): Xaa is D or E
  MISC_FEATURE (27)..(27): Xaa is A, C, G, P, M, V, I, L, Sme, or Sce
  MISC_FEATURE (28)..(28): Xaa is D or E
  MISC_FEATURE (29)..(29): Xaa is A, C, G, P, M, V, I, L, Sme, or Sce
  MISC_FEATURE (30)..(30): Xaa is R, H or K
  MISC_FEATURE (31)..(32): Xaa is A, C, G, P, M, V, I, L, Sme, or Sce
  MISC_FEATURE (33)..(33): Xaa is D or E
  MISC_FEATURE (34)..(36): Xaa is A, C, G, P, M, V, I, L, Sme, or Sce
  MISC_FEATURE (37)..(37): Xaa is S, T, N, or Q
  MISC_FEATURE (38)..(39): Xaa is A, C, G, P, M, V, I, L, Sme, or Sce
  MISC_FEATURE (40)..(40): Xaa is D or E
  MISC_FEATURE (41)..(41): Xaa is A, C, G, P, M, V, I, L, Sme, or Sce
  MISC_FEATURE (42)..(42): Xaa is R, H or K
  MISC_FEATURE (43)..(43): Xaa is A, C, G, P, M, V, I, L, Sme, or Sce
  MISC_FEATURE (44)..(44): Xaa is D or E
  MISC_FEATURE (45)..(45): Xaa is A, C, G, P, M, V, I, L, Sme, or Sce
  MISC_FEATURE (46)..(46): Xaa is D or E
  MISC_FEATURE (47)..(47): Xaa is A, C, G, P, M, V, I, L, Sme, or Sce
  MISC_FEATURE (48)..(48): Xaa is R, H or K
  MISC_FEATURE (49)..(50): Xaa is A, C, G, P, M, V, I, L, Sme, or Sce
  MISC_FEATURE (51)..(51): Xaa is R, H or K
  MISC_FEATURE (52)..(53): Xaa is S, T, N, or Q
  MISC_FEATURE (54)..(54): Xaa is A, C, G, P, M, V, I, L, Sme, or Sce
  MISC_FEATURE (55)..(55): Xaa is S, T, N, or Q
  MISC_FEATURE (56)..(56): Xaa is A, C, G, P, M, V, I, L, Sme, or Sce
  MISC_FEATURE (57)..(57): Xaa is F, W or Y
  MISC_FEATURE (58)..(58): Xaa is A, C, G, P, M, V, I, L, Sme, or Sce
  MISC_FEATURE (59)..(59): Xaa is D or E
  MISC_FEATURE (60)..(60): Xaa is A, C, G, P, M, V, I, L, Sme, or Sce
  MISC_FEATURE (61)..(62): Xaa is F, W or Y
  MISC_FEATURE (63)..(64): Xaa is A, C, G, P, M, V, I, L, Sme, or Sce
  MISC_FEATURE (65)..(65): Xaa is F, W or Y
  MISC_FEATURE (66)..(66): Xaa is A, C, G, P, M, V, I, L, Sme, or Sce
  MISC_FEATURE (67)..(67): Xaa is S, T, N, or Q
  MISC_FEATURE (68)..(68): Xaa is A, C, G, P, M, V, I, L, Sme, or Sce
  MISC_FEATURE (84)..(84): Xaa is S, T, N, or Q
  MISC_FEATURE (85)..(90): Xaa is A, C, G, P, M, V, I, L, Sme, or Sce
  MISC_FEATURE (91)..(92): Xaa is D or E
  MISC_FEATURE (93)..(94): Xaa is A, C, G, P, M, V, I, L, Sme, or Sce
  MISC_FEATURE (95)..(95): Xaa is R, H or K
  MISC_FEATURE (96)..(96): Xaa is F, W or Y
  MISC_FEATURE (97)..(98): Xaa is A, C, G, P, M, V, I, L, Sme, or Sce
  MISC_FEATURE (99)..(99): Xaa is S, T, N, or Q
  MISC_FEATURE (100)..(102): Xaa is A, C, G, P, M, V, I, L, Sme, or Sce
  MISC_FEATURE (103)..(103): Xaa is D or E
  MISC_FEATURE (104)..(104): Xaa is R, H or K
  MISC_FEATURE (105)..(105): Xaa is D or E
  MISC_FEATURE (106)..(107): Xaa is R, H or K
  MISC_FEATURE (108)..(109): Xaa is A, C, G, P, M, V, I, L, Sme, or Sce
  MISC_FEATURE (110)..(110): Xaa is F, W or Y
  MISC_FEATURE (111)..(113): Xaa is A, C, G, P, M, V, I, L, Sme, or Sce
  MISC_FEATURE (122)..(123): Xaa is S, T, N, or Q
  MISC_FEATURE (124)..(124): Xaa is A, C, G, P, M, V, I, L, Sme, or Sce
  MISC_FEATURE (125)..(125): Xaa is D or E
  MISC_FEATURE (126)..(126): Xaa is R, H or K
  MISC_FEATURE (127)..(127): Xaa is S, T, N, or Q
  MISC_FEATURE (128)..(128): Xaa is A, C, G, P, M, V, I, L, Sme, or Sce
  MISC_FEATURE (129)..(129): Xaa is F, W or Y
  MISC_FEATURE (130)..(130): Xaa is A, C, G, P, M, V, I, L, Sme, or Sce
  MISC_FEATURE (131)..(132): Xaa is R, H or K
  MISC_FEATURE (133)..(133): Xaa is A, C, G, P, M, V, I, L, Sme, or Sce
  MISC_FEATURE (134)..(136): Xaa is D or E
  MISC_FEATURE (137)..(137): Xaa is S, T, N, or Q
  MISC_FEATURE (138)..(140): Xaa is A, C, G, P, M, V, I, L, Sme, or Sce
  MISC_FEATURE (141)..(141): Xaa is R, H or K
  MISC_FEATURE (142)..(143): Xaa is F, W or Y
  MISC_FEATURE (144)..(144): Xaa is D or E
  MISC_FEATURE (153)..(153): Xaa is R, H or K
  MISC_FEATURE (154)..(154): Xaa is F, W or Y
  MISC_FEATURE (155)..(155): Xaa is S, T, N, or Q
  MISC_FEATURE (156)..(156): Xaa is A, C, G, P, M, V, I, L, Sme, or Sce
  MISC_FEATURE (157)..(157): Xaa is S, T, N, or Q
  MISC_FEATURE (158)..(158): Xaa is A, C, G, P, M, V, I, L, Sme, or Sce
  MISC_FEATURE (159)..(159): Xaa is R, H or K

SEQ ID NO: 33 - protein, 184 aa, Artificial Sequence; identical to SEQ ID NO: 23
  Synthetic
  MISC_FEATURE (1)..(1): X is any amino acid or is optionally absent
  MISC_FEATURE (2)..(3): X is S, T, N or Q
  MISC_FEATURE (4)..(8): Xaa is A, C, G, P, M, V, I, L, Selenomethionine (Sme), or Selenocysteine (Sce)
  MISC_FEATURE (9)..(9): X is D or E
  MISC_FEATURE (10)..(10): X is A, C, G, P, M, V, I, L, Sce or Sme
  MISC_FEATURE (11)..(12): X is S, T, N or Q
  MISC_FEATURE (13)..(14): X is A, C, G, P, M, V, I, L, Sce or Sme
  MISC_FEATURE (15)..(15): X is R, H, or K
  MISC_FEATURE (16)..(17): X is A, C, G, P, M, V, I, L, Sce or Sme
  MISC_FEATURE (18)..(18): X is D or E
  MISC_FEATURE (19)..(20): X is A, C, G, P, M, V, I, L, Sce or Sme
  MISC_FEATURE (21)..(21): X is D or E
  MISC_FEATURE (22)..(24): X is A, C, G, P, M, V, I, L, Sce or Sme
  MISC_FEATURE (25)..(25): X is R, H, or K
  MISC_FEATURE (26)..(26): X is S, T, N or Q
  MISC_FEATURE (27)..(27): X is A, C, G, P, M, V, I, L, Sce or Sme
  MISC_FEATURE (28)..(28): X is S, T, N or Q
  MISC_FEATURE (29)..(29): X is A, C, G, P, M, V, I, L, Sce or Sme
  MISC_FEATURE (30)..(30): X is D or E
  MISC_FEATURE (31)..(33): X is A, C, G, P, M, V, I, L, Sce or Sme
  MISC_FEATURE (34)..(34): X is S, T, N or Q
  MISC_FEATURE (35)..(35): X is R, H, or K
  MISC_FEATURE (36)..(36): X is S, T, N or Q
  MISC_FEATURE (37)..(37): X is A, C, G, P, M, V, I, L, Sce or Sme
  MISC_FEATURE (38)..(38): X is S, T, N or Q
  MISC_FEATURE (39)..(40): X is A, C, G, P, M, V, I, L, Sce or Sme
  MISC_FEATURE (41)..(41): X is R, H, or K
  MISC_FEATURE (42)..(42): X is F, W, or Y
  MISC_FEATURE (43)..(48): X is A, C, G, P, M, V, I, L, Sce or Sme
  MISC_FEATURE (49)..(49): X is D or E
  MISC_FEATURE (50)..(53): X is A, C, G, P, M, V, I, L, Sce or Sme
  MISC_FEATURE (54)..(55): X is S, T, N or Q
  MISC_FEATURE (56)..(57): X is A, C, G, P, M, V, I, L, Sce or Sme
  MISC_FEATURE (58)..(58): X is D or E
  MISC_FEATURE (59)..(59): X is S, T, N or Q
  MISC_FEATURE (60)..(60): X is A, C, G, P, M, V, I, L, Sce or Sme
  MISC_FEATURE (61)..(63): X is S, T, N or Q
  MISC_FEATURE (64)..(65): X is A, C, G, P, M, V, I, L, Sce or Sme
  MISC_FEATURE (66)..(66): X is D or E
  MISC_FEATURE (67)..(69): X is A, C, G, P, M, V, I, L, Sce or Sme
  MISC_FEATURE (70)..(70): X is D or E
  MISC_FEATURE (71)..(71): X is S, T, N or Q
  MISC_FEATURE (72)..(75): X is A, C, G, P, M, V, I, L, Sce or Sme
  MISC_FEATURE (76)..(76): X is S, T, N or Q
  MISC_FEATURE (77)..(77): X is A, C, G, P, M, V, I, L, Sce or Sme
  MISC_FEATURE (78)..(78): X is R, H, or K
  MISC_FEATURE (79)..(79): X is A, C, G, P, M, V, I, L, Sce or Sme
  MISC_FEATURE (80)..(80): X is S, T, N or Q
  MISC_FEATURE (81)..(85): X is A, C, G, P, M, V, I, L, Sce or Sme
  MISC_FEATURE (86)..(86): X is S, T, N or Q
  MISC_FEATURE (87)..(88): X is A, C, G, P, M, V, I, L, Sce or Sme
  MISC_FEATURE (89)..(90): X is S, T, N or Q
  MISC_FEATURE (91)..(91): X is A, C, G, P, M, V, I, L, Sce or Sme
  MISC_FEATURE (92)..(92): X is D or E
  MISC_FEATURE (93)..(94): X is R, H, or K
  MISC_FEATURE (95)..(95): X is S, T, N or Q
  MISC_FEATURE (97)..(97): X is A, C, G, P, M, V, I, L, Sce or Sme
  MISC_FEATURE (98)..(98): X is S, T, N or Q
  MISC_FEATURE (99)..(100): X is A, C, G, P, M, V, I, L, Sce or Sme
  MISC_FEATURE (101)..(101): X is D or E
  MISC_FEATURE (102)..(102): X is S, T, N or Q
  MISC_FEATURE (103)..(103): X is F, W, or Y
  MISC_FEATURE (104)..(104): X is S, T, N or Q
  MISC_FEATURE (105)..(109): X is A, C, G, P, M, V, I, L, Sce or Sme
  MISC_FEATURE (110)..(110): X is S, T, N or Q
  MISC_FEATURE (111)..(112): X is A, C, G, P, M, V, I, L, Sce or Sme
  MISC_FEATURE (113)..(113): X is D or E
  MISC_FEATURE (116)..(116): X is A, C, G, P, M, V, I, L, Sce or Sme
  MISC_FEATURE (121)..(121): X is A, C, G, P, M, V, I, L, Sce or Sme
  MISC_FEATURE (122)..(122): X is S, T, N or Q
  MISC_FEATURE (123)..(124): X is A, C, G, P, M, V, I, L, Sce or Sme
  MISC_FEATURE (125)..(125): X is R, H, or K
  MISC_FEATURE (126)..(126): X is A, C, G, P, M, V, I, L, Sce or Sme
  MISC_FEATURE (127)..(127): X is R, H, or K
  MISC_FEATURE (128)..(129): X is A, C, G, P, M, V, I, L, Sce or Sme
  MISC_FEATURE (130)..(130): X is F, W, or Y
  MISC_FEATURE (131)..(134): X is A, C, G, P, M, V, I, L, Sce or Sme
  MISC_FEATURE (135)..(135): X is R, H, or K
  MISC_FEATURE (136)..(136): X is A, C, G, P, M, V, I, L, Sce or Sme
  MISC_FEATURE (137)..(137): X is F, W, or Y
  MISC_FEATURE (138)..(142): X is A, C, G, P, M, V, I, L, Sce or Sme
  MISC_FEATURE (158)..(158): X is A, C, G, P, M, V, I, L, Sce or Sme
  MISC_FEATURE (161)..(161): X is R, H, or K
  MISC_FEATURE (162)..(165): X is A, C, G, P, M, V, I, L, Sce or Sme
  MISC_FEATURE (166)..(166): X is F, W, or Y
  MISC_FEATURE (173)..(173): X is A, C, G, P, M, V, I, L, Sce or Sme
  MISC_FEATURE (174)..(174): X is R, H, or K
  MISC_FEATURE (175)..(175): X is D or E
  MISC_FEATURE (176)..(177): X is A, C, G, P, M, V, I, L, Sce or Sme
  MISC_FEATURE (178)..(178): X is F, W, or Y
  MISC_FEATURE (179)..(179): X is R, H, or K
  MISC_FEATURE (180)..(180): X is S, T, N or Q
  MISC_FEATURE (181)..(182): X is A, C, G, P, M, V, I, L, Sce or Sme
  MISC_FEATURE (183)..(183): X is D or E
  MISC_FEATURE (184)..(184): X is A, C, G, P, M, V, I, L, Sce or Sme

SEQ ID NO: 34 - protein, 103 aa, Artificial Sequence; identical to SEQ ID NO: 24
  Synthetic
  MISC_FEATURE (1)..(1): X is any amino acid or is optionally absent
  MISC_FEATURE (2)..(3): X is D or E
  MISC_FEATURE (4)..(7): Xaa is A, C, G, P, M, V, I, L, Selenomethionine (Sme), or Selenocysteine (Sce)
  MISC_FEATURE (8)..(8): X is S, T, N, or Q
  MISC_FEATURE (9)..(10): X is A, C, G, P, M, V, I, L, Sce or Sme
  MISC_FEATURE (11)..(11): X is S, T, N, or Q
  MISC_FEATURE (18)..(19): X is A, C, G, P, M, V, I, L, Sce or Sme
  MISC_FEATURE (21)..(23): X is A, C, G, P, M, V, I, L, Sce or Sme
  MISC_FEATURE (24)..(25): X is D or E
  MISC_FEATURE (26)..(26): X is R, H, or K
  MISC_FEATURE (27)..(31): X is A, C, G, P, M, V, I, L, Sce or Sme
  MISC_FEATURE (32)..(32): X is S, T, N, or Q
  MISC_FEATURE (34)..(34): X is A, C, G, P, M, V, I, L, Sce or Sme
  MISC_FEATURE (39)..(39): X is S, T, N, or Q
  MISC_FEATURE (41)..(41): X is F, W, or Y
  MISC_FEATURE (42)..(42): X is R, H, or K
  MISC_FEATURE (44)..(44): X is S, T, N, or Q
  MISC_FEATURE (45)..(45): X is A, C, G, P, M, V, I, L, Sce or Sme
  MISC_FEATURE (50)..(50): X is D or E
  MISC_FEATURE (52)..(52): X is D or E
  MISC_FEATURE (54)..(57): X is A, C, G, P, M, V, I, L, Sce or Sme
  MISC_FEATURE (58)..(58): X is R, H, or K
  MISC_FEATURE (59)..(61): X is S, T, N, or Q
  MISC_FEATURE (62)..(62): X is R, H, or K
  MISC_FEATURE (63)..(63): X is A, C, G, P, M, V, I, L, Sce or Sme
  MISC_FEATURE (64)..(64): X is F, W, or Y
  MISC_FEATURE (65)..(65): X is A, C, G, P, M, V, I, L, Sce or Sme
  MISC_FEATURE (66)..(66): X is R, H, or K
  MISC_FEATURE (67)..(67): X is A, C, G, P, M, V, I, L, Sce or Sme
  MISC_FEATURE (68)..(68): X is R, H, or K
  MISC_FEATURE (69)..(69): X is D or E
  MISC_FEATURE (70)..(70): X is R, H, or K
  MISC_FEATURE (71)..(71): X is A, C, G, P, M, V, I, L, Sce or Sme
  MISC_FEATURE (72)..(72): X is R, H, or K
  MISC_FEATURE (73)..(74): X is A, C, G, P, M, V, I, L, Sce or Sme
  MISC_FEATURE (75)..(75): X is R, H, or K
  MISC_FEATURE (76)..(76): X is A, C, G, P, M, V, I, L, Sce or Sme
  MISC_FEATURE (77)..(77): X is F, W, or Y
  MISC_FEATURE (78)..(78): X is S, T, N, or Q
  MISC_FEATURE (79)..(80): X is A, C, G, P, M, V, I, L, Sce or Sme
  MISC_FEATURE (81)..(81): X is D or E
  MISC_FEATURE (82)..(88): X is A, C, G, P, M, V, I, L, Sce or Sme
  MISC_FEATURE (89)..(89): X is D or E
  MISC_FEATURE (90)..(90): X is A, C, G, P, M, V, I, L, Sce or Sme
  MISC_FEATURE (91)..(91): X is S, T, N, or Q
  MISC_FEATURE (92)..(92): X is R, H, or K
  MISC_FEATURE (93)..(93): X is D or E
  MISC_FEATURE (94)..(94): X is F, W, or Y
  MISC_FEATURE (95)..(95): X is A, C, G, P, M, V, I, L, Sce or Sme
  MISC_FEATURE (96)..(96): X is D or E
  MISC_FEATURE (97)..(97): X is F, W, or Y
  MISC_FEATURE (98)..(98): X is A, C, G, P, M, V, I, L, Sce or Sme
  MISC_FEATURE (99)..(99): X is R, H, or K
  MISC_FEATURE (100)..(100): X is D or E
  MISC_FEATURE (101)..(102): X is S, T, N, or Q
  MISC_FEATURE (103)..(103): X is A, C, G, P, M, V, I, L, Sce or Sme

SEQ ID NO: 35 - protein, 122 aa, Artificial Sequence; identical to SEQ ID NO: 25
  Synthetic
  MISC_FEATURE (1)..(1): Xaa is any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H or K
  MISC_FEATURE (4)..(5): Xaa is A, C, G, P, M, V, I, L, Sce, or Sme
  MISC_FEATURE (6)..(6): Xaa is R, H or K
  MISC_FEATURE (7)..(8): Xaa is A, C, G, P, M, V, I, L, Sce, or Sme
  MISC_FEATURE (10)..(119): Xaa is S, T, N, or Q
  MISC_FEATURE (11)..(11): Xaa is A, C, G, P, M, V, I, L, Sce, or Sme
  MISC_FEATURE (14)..(14): Xaa is D or E
  MISC_FEATURE (19)..(19): Xaa is A, C, G, P, M, V, I, L, Sce, or Sme
  MISC_FEATURE (23)..(23): Xaa is S, T, N, or Q
  MISC_FEATURE (26)..(27): Xaa is A, C, G, P, M, V, I, L, Sce, or Sme
  MISC_FEATURE (30)..(31): Xaa is A, C, G, P, M, V, I, L, Sce, or Sme
  MISC_FEATURE (33)..(33): Xaa is A, C, G, P, M, V, I, L, Sce, or Sme
  MISC_FEATURE (34)..(34): Xaa is S, T, N, or Q
  MISC_FEATURE (35)..(36): Xaa is A, C, G, P, M, V, I, L, Sce, or Sme
  MISC_FEATURE (37)..(38): Xaa is S, T, N, or Q
  MISC_FEATURE (39)..(39): Xaa is F, W, or Y
  MISC_FEATURE (40)..(41): Xaa is D or E
  MISC_FEATURE (42)..(46): Xaa is A, C, G, P, M, V, I, L, Sce, or Sme
  MISC_FEATURE (47)..(47): Xaa is F, W, or Y
  MISC_FEATURE (48)..(48): Xaa is S, T, N, or Q
  MISC_FEATURE (49)..(49): Xaa is A, C, G, P, M, V, I, L, Sce, or Sme
  MISC_FEATURE (50)..(50): Xaa is S, T, N, or Q
  MISC_FEATURE (51)..(52): Xaa is D or E
  MISC_FEATURE (53)..(53): Xaa is A, C, G, P, M, V, I, L, Sce, or Sme
  MISC_FEATURE (54)..(55): Xaa is S, T, N, or Q
  MISC_FEATURE (56)..(56): Xaa is A, C, G, P, M, V, I, L, Sce, or Sme
  MISC_FEATURE (57)..(57): Xaa is F, W, or Y
  MISC_FEATURE (58)..(59): Xaa is A, C, G, P, M, V, I, L, Sce, or Sme
  MISC_FEATURE (62)..(62): Xaa is A, C, G, P, M, V, I, L, Sce, or Sme
  MISC_FEATURE (63)..(63): Xaa is R, H or K
  MISC_FEATURE (66)..(67): Xaa is A, C, G, P, M, V, I, L, Sce, or Sme
  MISC_FEATURE (69)..(69): Xaa is R, H or K
  MISC_FEATURE (70)..(73): Xaa is A, C, G, P, M, V, I, L, Sce, or Sme
  MISC_FEATURE (74)..(74): Xaa is S, T, N, or Q
  MISC_FEATURE (75)..(75): Xaa is A, C, G, P, M, V, I, L, Sce, or Sme
  MISC_FEATURE (76)..(76): Xaa is R, H or K
  MISC_FEATURE (77)..(77): Xaa is D or E
  MISC_FEATURE (78)..(82): Xaa is A, C, G, P, M, V, I, L, Sce, or Sme
  MISC_FEATURE (83)..(83): Xaa is S, T, N, or Q
  MISC_FEATURE (84)..(85): Xaa is A, C, G, P, M, V, I, L, Sce, or Sme
  MISC_FEATURE (86)..(86): Xaa is R, H or K
  MISC_FEATURE (87)..(88): Xaa is A, C, G, P, M, V, I, L, Sce, or Sme
  MISC_FEATURE (89)..(89): Xaa is R, H or K
  MISC_FEATURE (90)..(93): Xaa is A, C, G, P, M, V, I, L, Sce, or Sme
  MISC_FEATURE (94)..(94): Xaa is F, W, or Y
  MISC_FEATURE (95)..(96): Xaa is S, T, N, or Q
  MISC_FEATURE (97)..(97): Xaa is D or E
  MISC_FEATURE (98)..(98): Xaa is S, T, N, or Q
  MISC_FEATURE (99)..(99): Xaa is A, C, G, P, M, V, I, L, Sce, or Sme
  MISC_FEATURE (100)..(100): Xaa is S, T, N, or Q
  MISC_FEATURE (101)..(101): Xaa is D or E
  MISC_FEATURE (102)..(102): Xaa is R, H or K
  MISC_FEATURE (103)..(103): Xaa is A, C, G, P, M, V, I, L, Sce, or Sme
  MISC_FEATURE (104)..(105): Xaa is R, H or K
  MISC_FEATURE (106)..(106): Xaa is A, C, G, P, M, V, I, L, Sce, or Sme
  MISC_FEATURE (107)..(107): Xaa is F, W, or Y
  MISC_FEATURE (108)..(108): Xaa is A, C, G, P, M, V, I, L, Sce, or Sme
  MISC_FEATURE (110)..(110): Xaa is D or E
  MISC_FEATURE (111)..(112): Xaa is A, C, G, P, M, V, I, L, Sce, or Sme
  MISC_FEATURE (113)..(113): Xaa is R, H or K
  MISC_FEATURE (114)..(114): Xaa is A, C, G, P, M, V, I, L, Sce, or Sme
  MISC_FEATURE (115)..(115): Xaa is R, H or K
  MISC_FEATURE (116)..(116): Xaa is A, C, G, P, M, V, I, L, Sce, or Sme
  MISC_FEATURE (117)..(117): Xaa is D or E
  MISC_FEATURE (118)..(118): Xaa is A, C, G, P, M, V, I, L, Sce, or Sme
  MISC_FEATURE (119)..(119): Xaa is D or E
  MISC_FEATURE (120)..(120): Xaa is S, T, N, or Q
  MISC_FEATURE (121)..(121): Xaa is A, C, G, P, M, V, I, L, Sce, or Sme
  MISC_FEATURE (122)..(122): Xaa is S, T, N, or Q

SEQ ID NO: 36 - protein, 177 aa, Artificial Sequence; identical to SEQ ID NO: 26
  Synthetic
  MISC_FEATURE (1)..(1): Xaa is any amino acid or is optionally absent
  MISC_FEATURE (2)..(2): Xaa is S, T, N or Q
  MISC_FEATURE (3)..(3): Xaa is R, H, or K
  MISC_FEATURE (4)..(4): Xaa is A, C, G, P, M, V, I, L, Selenomethionine (Sme), or Selenocysteine (Sce)
  MISC_FEATURE (5)..(5): Xaa is R, H, or K
  MISC_FEATURE (6)..(9): Xaa is A, C, G, P, M, V, I, L, Sce, or Sme
  MISC_FEATURE (10)..(10): Xaa is S, T, N or Q
  MISC_FEATURE (11)..(11): Xaa is A, C, G, P, M, V, I, L, Sce, or Sme
  MISC_FEATURE (12)..(12): Xaa is S, T, N or Q
  MISC_FEATURE (13)..(13): Xaa is D or E
  MISC_FEATURE (14)..(14): Xaa is R, H, or K
  MISC_FEATURE (15)..(15): Xaa is A, C, G, P, M, V, I, L, Sce, or Sme
  MISC_FEATURE (16)..(16): Xaa is S, T, N or Q
  MISC_FEATURE (17)..(19): Xaa is A, C, G, P, M, V, I, L, Sce, or Sme
  MISC_FEATURE (20)..(20): Xaa is S, T, N or Q
  MISC_FEATURE (21)..(21): Xaa is A, C, G, P, M, V, I, L, Sce, or Sme
  MISC_FEATURE (22)..(22): Xaa is D or E
  MISC_FEATURE (24)..(24): Xaa is S, T, N or Q
  MISC_FEATURE (25)..(25): Xaa is A, C, G, P, M, V, I, L, Sce, or Sme
  MISC_FEATURE (28)..(29): Xaa is A, C, G, P, M, V, I, L, Sce, or Sme
  MISC_FEATURE (32)..(32): Xaa is A, C, G, P, M, V, I, L, Sce, or Sme
  MISC_FEATURE (36)..(36): Xaa is A, C, G, P, M, V, I, L, Sce, or Sme
  MISC_FEATURE (37)..(38): Xaa is S, T, N or Q
  MISC_FEATURE (39)..(39): Xaa is D or E
  MISC_FEATURE (40)..(40): Xaa is F, W, or Y
  MISC_FEATURE (41)..(41): Xaa is D or E
  MISC_FEATURE (42)..(43): Xaa is A, C, G, P, M, V, I, L, Sce, or Sme
  MISC_FEATURE (44)..(44): Xaa is F, W, or Y
  MISC_FEATURE (45)..(45): Xaa is S, T, N or Q
  MISC_FEATURE (46)..(48): Xaa is A, C, G, P, M, V, I, L, Sce, or Sme
  MISC_FEATURE (49)..(50): Xaa is D or E
  MISC_FEATURE (51)..(51): Xaa is S, T, N or Q
  MISC_FEATURE (52)..(52): Xaa is D or E
  MISC_FEATURE (53)..(54): Xaa is A, C, G, P, M, V, I, L, Sce, or Sme
  MISC_FEATURE (55)..(55): Xaa is D or E
  MISC_FEATURE (56)..(57): Xaa is S, T, N or Q
  MISC_FEATURE (58)..(59): Xaa is A, C, G, P, M, V, I, L, Sce, or Sme
  MISC_FEATURE (60)..(60): Xaa is R, H, or K
  MISC_FEATURE (61)..(62): Xaa is A, C, G, P, M, V, I, L, Sce, or Sme
  MISC_FEATURE (63)..(64): Xaa is D or E
  MISC_FEATURE (65)..(65): Xaa is S, T, N or Q
  MISC_FEATURE (66)..(66): Xaa is D or E
  MISC_FEATURE (67)..(71): Xaa is A, C, G, P, M, V, I, L, Sce, or Sme
  MISC_FEATURE (72)..(73): Xaa is S, T, N or Q
  MISC_FEATURE (74)..(75): Xaa is A, C, G, P, M, V, I, L, Sce, or Sme
  MISC_FEATURE (76)..(76): Xaa is S, T, N or Q
  MISC_FEATURE (77)..(79): Xaa is A, C, G, P, M, V, I, L, Sce, or Sme
  MISC_FEATURE (80)..(81): Xaa is R, H, or K
  MISC_FEATURE (82)..(82): Xaa is D or E
  MISC_FEATURE (83)..(83): Xaa is A, C, G, P, M, V, I, L, Sce, or Sme
  MISC_FEATURE (84)..(84): Xaa is S, T, N or Q
  MISC_FEATURE (85)..(85): Xaa is A, C, G, P, M, V, I, L, Sce, or Sme
  MISC_FEATURE (86)..(86): Xaa is D or E
  MISC_FEATURE (87)..(87): Xaa is A, C, G, P, M, V, I, L, Sce, or Sme
  MISC_FEATURE (88)..(88): Xaa is S, T, N or Q
  MISC_FEATURE (89)..(89): Xaa is D or E
  MISC_FEATURE (90)..(92): Xaa is A, C, G, P, M, V, I, L, Sce, or Sme
  MISC_FEATURE (93)..(93): Xaa is D or E
  MISC_FEATURE (94)..(94): Xaa is R, H, or K
  MISC_FEATURE (95)..(98): Xaa is A, C, G, P, M, V, I, L, Sce, or Sme
  MISC_FEATURE (99)..(99): Xaa is F, W, or Y
  MISC_FEATURE (100)..(100): Xaa is A, C, G, P, M, V, I, L, Sce, or Sme
  MISC_FEATURE (101)..(101): Xaa is D or E
  MISC_FEATURE (102)..(103): Xaa is A, C, G, P, M, V, I, L, Sce, or Sme
  MISC_FEATURE (104)..(104): Xaa is R, H, or K
  MISC_FEATURE (105)..(105): Xaa is A, C, G, P, M, V, I, L, Sce, or Sme
  MISC_FEATURE (106)..(106): Xaa is D or E
  MISC_FEATURE (107)..(107): Xaa is S, T, N or Q
  MISC_FEATURE (108)..(108): Xaa is A, C, G, P, M, V, I, L, Sce, or Sme
  MISC_FEATURE (109)..(109): Xaa is R, H, or K
  MISC_FEATURE (110)..(110): Xaa is D or E
  MISC_FEATURE (111)..(112): Xaa is A, C, G, P, M, V, I, L, Sce, or Sme
  MISC_FEATURE (113)..(113): Xaa is S, T, N or Q
  MISC_FEATURE (114)..(116): Xaa is A, C, G, P, M, V, I, L, Sce, or Sme
  MISC_FEATURE (117)..(117): Xaa is S, T, N or Q
  MISC_FEATURE (118)..(118): Xaa is R, H, or K
  MISC_FEATURE (119)..(120): Xaa is S, T, N or Q
  MISC_FEATURE (121)..(123): Xaa is A, C, G, P, M, V, I, L, Sce, or Sme
  MISC_FEATURE (124)..(124): Xaa is R, H, or K
  MISC_FEATURE (125)..(125): Xaa is A, C, G, P, M, V, I, L, Sce, or Sme
  MISC_FEATURE (126)..(126): Xaa is D or E
  MISC_FEATURE (127)..(127): Xaa is S, T, N or Q
  MISC_FEATURE (128)..(130): Xaa is A, C, G, P, M, V, I, L, Sce, or Sme
  MISC_FEATURE (131)..(131): Xaa is S, T, N or Q
  MISC_FEATURE (132)..(134): Xaa is A, C, G, P, M, V, I, L, Sce, or Sme
  MISC_FEATURE (135)..(135): Xaa is D or E
  MISC_FEATURE (136)..(136): Xaa is A, C, G, P, M, V, I, L, Sce, or Sme
  MISC_FEATURE (139)..(139): Xaa is A, C, G, P, M, V, I, L, Sce, or Sme
  MISC_FEATURE (142)..(143): Xaa is A, C, G, P, M, V, I, L, Sce, or Sme
  MISC_FEATURE (145)..(146): Xaa is A, C, G, P, M, V, I, L, Sce, or Sme
  MISC_FEATURE (147)..(147): Xaa is F, W, or Y
  MISC_FEATURE (148)..(151): Xaa is A, C, G, P, M, V, I, L, Sce, or Sme
  MISC_FEATURE (152)..(152): Xaa is F, W, or Y
  MISC_FEATURE (153)..(154): Xaa is A, C, G, P, M, V, I, L, Sce, or Sme
  MISC_FEATURE (155)..(155): Xaa is D or E
  MISC_FEATURE (156)..(157): Xaa is A, C, G, P, M, V, I, L, Sce, or Sme
  MISC_FEATURE (158)..(158): Xaa is D or E
  MISC_FEATURE (159)..(160): Xaa is A, C, G, P, M, V, I, L, Sce, or Sme
  MISC_FEATURE (161)..(161): Xaa is F, W, or Y
  MISC_FEATURE (162)..(162): Xaa is A, C, G, P, M, V, I, L, Sce, or Sme
  MISC_FEATURE (163)..(163): Xaa is D or E
  MISC_FEATURE (164)..(164): Xaa is A, C, G, P, M, V, I, L, Sce, or Sme
  MISC_FEATURE (165)..(165): Xaa is S, T, N or Q
  MISC_FEATURE (166)..(166): Xaa is D or E
  MISC_FEATURE (169)..(169): Xaa is A, C, G, P, M, V, I, L, Sce, or Sme
  MISC_FEATURE (170)..(170): Xaa is R, H, or K
  MISC_FEATURE (171)..(171): Xaa is A, C, G, P, M, V, I, L, Sce, or Sme
  MISC_FEATURE (172)..(172): Xaa is F, W, or Y
  MISC_FEATURE (173)..(173): Xaa is R, H, or K
  MISC_FEATURE (174)..(174): Xaa is A, C, G, P, M, V, I, L, Sce, or Sme
  MISC_FEATURE (175)..(175): Xaa is R, H, or K
  MISC_FEATURE (176)..(176): Xaa is A, C, G, P, M, V, I, L, Sce, or Sme
  MISC_FEATURE (177)..(177): Xaa is R, H, or K

SEQ ID NO: 37 - protein, 122 aa, Artificial Sequence; identical to SEQ ID NO: 27
  Synthetic
  MISC_FEATURE (1)..(1): Xaa is any amino acid or optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H, or K
  MISC_FEATURE (4)..(5): Xaa is A, C, G, P, M, V, I, L, Sce, or Sme
  MISC_FEATURE (6)..(6): Xaa is R, H, or K
  MISC_FEATURE (7)..(9): Xaa is A, C, G, P, M, V, I, L, Sce, or Sme
  MISC_FEATURE (10)..(10): Xaa is S, T, N or Q
  MISC_FEATURE (11)..(11): Xaa is A, C, G, P, M, V, I, L, Sce, or Sme
  MISC_FEATURE (14)..(14): Xaa is D or E
  MISC_FEATURE (19)..(19): Xaa is A, C, G, P, M, V, I, L, Sce, or Sme
  MISC_FEATURE (22)..(22): Xaa is A, C, G, P, M, V, I, L, Sce, or Sme
  MISC_FEATURE (23)..(23): Xaa is S, T, N or Q
  MISC_FEATURE (26)..(27): Xaa is A, C, G, P, M, V, I, L, Sce, or Sme
  MISC_FEATURE (29)..(29): Xaa is R, H, or K
  MISC_FEATURE (30)..(31): Xaa is A, C, G, P, M, V, I, L, Sce, or Sme
  MISC_FEATURE (32)..(32): Xaa is D or E
  MISC_FEATURE (33)..(33): Xaa is A, C, G, P, M, V, I, L, Sce, or Sme
  MISC_FEATURE (34)..(34): Xaa is S, T, N or Q
  MISC_FEATURE (35)..(36): Xaa is A, C, G, P, M, V, I, L, Sce, or Sme
  MISC_FEATURE (37)..(38): Xaa is S, T, N or Q
  MISC_FEATURE (39)..(39): Xaa is F, W or Y
  MISC_FEATURE (40)..(41): Xaa is D or E
  MISC_FEATURE (42)..(46): Xaa is A, C, G, P, M, V, I, L, Sce, or Sme
  MISC_FEATURE (47)..(47): Xaa is F, W or Y
  MISC_FEATURE (48)..(48): Xaa is S, T, N or Q
  MISC_FEATURE (49)..(49): Xaa is A, C, G, P, M, V, I, L, Sce, or Sme
  MISC_FEATURE (50)..(50): Xaa is S, T, N or Q
  MISC_FEATURE (51)..(52): Xaa is D or E
  MISC_FEATURE (53)..(53): Xaa is A, C, G, P, M, V, I, L, Sce, or Sme
  MISC_FEATURE (54)..(55): Xaa is S, T, N or Q
  MISC_FEATURE (56)..(56): Xaa is A, C, G, P, M, V, I, L, Sce, or Sme
  MISC_FEATURE (57)..(57): Xaa is F, W or Y
  MISC_FEATURE (58)..(59): Xaa is A, C, G, P, M, V, I, L, Sce, or Sme
  MISC_FEATURE (60)..(60): Xaa is D or E
  MISC_FEATURE (61)..(62): Xaa is A, C, G, P, M, V, I, L, Sce, or Sme
  MISC_FEATURE (63)..(63): Xaa is R, H, or K
  MISC_FEATURE (65)..(67): Xaa is A, C, G, P, M, V, I, L, Sce, or Sme
  MISC_FEATURE (68)..(69): Xaa is R, H, or K
  MISC_FEATURE (70)..(73): Xaa is A, C, G, P, M, V, I, L, Sce, or Sme
  MISC_FEATURE (74)..(74): Xaa is S, T, N or Q
  MISC_FEATURE (75)..(75): Xaa is A, C, G, P, M, V, I, L, Sce, or Sme
  MISC_FEATURE (76)..(76): Xaa is R, H, or K
  MISC_FEATURE (77)..(77): Xaa is D or E
  MISC_FEATURE (78)..(82): Xaa is A, C, G, P, M, V, I, L, Sce, or Sme
  MISC_FEATURE (83)..(83): Xaa is S, T, N or Q
  MISC_FEATURE (84)..(85): Xaa is A, C, G, P, M, V, I, L, Sce, or Sme
  MISC_FEATURE (86)..(86): Xaa is R, H, or K
  MISC_FEATURE (87)..(88): Xaa is A, C, G, P, M, V, I, L, Sce, or Sme
  MISC_FEATURE (89)..(89): Xaa is R, H, or K
  MISC_FEATURE (90)..(93): Xaa is A, C, G, P, M, V, I, L, Sce, or Sme
  MISC_FEATURE (94)..(94): Xaa is F, W or Y
  MISC_FEATURE (95)..(96): Xaa is S, T, N or Q
  MISC_FEATURE (97)..(97): Xaa is D or E
  MISC_FEATURE (98)..(98): Xaa is S, T, N or Q
  MISC_FEATURE (99)..(99): Xaa is A, C, G, P, M, V, I, L, Sce, or Sme
  MISC_FEATURE (100)..(100): Xaa is S, T, N or Q
  MISC_FEATURE (101)..(101): Xaa is D or E
  MISC_FEATURE (102)..(102): Xaa is R, H, or K
  MISC_FEATURE (103)..(103): Xaa is A, C, G, P, M, V, I, L, Sce, or Sme
  MISC_FEATURE (104)..(105): Xaa is R, H, or K
  MISC_FEATURE (106)..(106): Xaa is A, C, G, P, M, V, I, L, Sce, or Sme
  MISC_FEATURE (107)..(107): Xaa is F, W or Y
  MISC_FEATURE (108)..(108): Xaa is A, C, G, P, M, V, I, L, Sce, or Sme
  MISC_FEATURE (110)..(110): Xaa is D or E
  MISC_FEATURE (111)..(112): Xaa is A, C, G, P, M, V, I, L, Sce, or Sme
  MISC_FEATURE (113)..(113): Xaa is R, H, or K
  MISC_FEATURE (114)..(114): Xaa is A, C, G, P, M, V, I, L, Sce, or Sme
  MISC_FEATURE (115)..(115): Xaa is R, H, or K
  MISC_FEATURE (116)..(116): Xaa is A, C, G, P, M, V, I, L, Sce, or Sme
  MISC_FEATURE (117)..(117): Xaa is D or E
  MISC_FEATURE (118)..(118): Xaa is A, C, G, P, M, V, I, L, Sce, or Sme
  MISC_FEATURE (119)..(119): Xaa is D or E
  MISC_FEATURE (120)..(120): Xaa is S, T, N or Q
  MISC_FEATURE (121)..(121): Xaa is A, C, G, P, M, V, I, L, Sce, or Sme
  MISC_FEATURE (122)..(122): Xaa is S, T, N or Q

SEQ ID NO: 38 - protein, 172 aa, Artificial Sequence; identical to SEQ ID NO: 28
  Synthetic
  MISC_FEATURE (1)..(1): Xaa is any amino acid or is optionally absent
  MISC_FEATURE (2)..(2): Xaa is R, H, or K
  MISC_FEATURE (3)..(3): Xaa is A, C, G, P, M, V, I, L, Selenomethionine (Sme), or Selenocysteine (Sce)
  MISC_FEATURE (4)..(5): Xaa is S, T, N or Q
  MISC_FEATURE (6)..(6): Xaa is R, H, or K
  MISC_FEATURE (7)..(8): Xaa is A, C, G, P, M, V, I, L, Sce, or Sme
  MISC_FEATURE (9)..(9): Xaa is D or E
  MISC_FEATURE (10)..(10): Xaa is R, H, or K
  MISC_FEATURE (11)..(11): Xaa is A, C, G, P, M, V, I, L, Sce, or Sme
  MISC_FEATURE (12)..(13): Xaa is S, T, N or Q
  MISC_FEATURE (14)..(14): Xaa is R, H, or K
  MISC_FEATURE (15)..(15): Xaa is A, C, G, P, M, V, I, L, Sce, or Sme
  MISC_FEATURE (16)..(16): Xaa is F, W, or Y
  MISC_FEATURE (17)..(18): Xaa is A, C, G, P, M, V, I, L, Sce, or Sme
  MISC_FEATURE (19)..(20): Xaa is D or E
  MISC_FEATURE (21)..(21): Xaa is A, C, G, P, M, V, I, L, Sce, or Sme
  MISC_FEATURE (22)..(22): Xaa is F, W, or Y
  MISC_FEATURE (24)..(24): Xaa is D or E
  MISC_FEATURE (25)..(25): Xaa is S, T, N or Q
  MISC_FEATURE (26)..(28): Xaa is A, C, G, P, M, V, I, L, Sce, or Sme
  MISC_FEATURE (29)..(29): Xaa is D or E
  MISC_FEATURE (30)..(30): Xaa is A, C, G, P, M, V, I, L, Sce, or Sme
  MISC_FEATURE (31)..(31): Xaa is S, T, N or Q
  MISC_FEATURE (32)..(32): Xaa is A, C, G, P, M, V, I, L, Sce, or Sme
  MISC_FEATURE (33)..(33): Xaa is S, T, N or Q
  MISC_FEATURE (34)..(34): Xaa is A, C, G, P, M, V, I, L, Sce, or Sme
  MISC_FEATURE (35)..(36): Xaa is D or E
  MISC_FEATURE (37)..(37): Xaa is A, C, G, P, M, V, I, L, Sce, or Sme
  MISC_FEATURE (38)..(39): Xaa is S, T, N or Q
  MISC_FEATURE (40)..(40): Xaa is F, W, or Y
  MISC_FEATURE (41)..(42): Xaa is A, C, G, P, M, V, I, L, Sce, or Sme
  MISC_FEATURE (43)..(43): Xaa is D or E
  MISC_FEATURE (44)..(44): Xaa is A, C, G, P, M, V, I, L, Sce, or Sme
  MISC_FEATURE (45)..(46): Xaa is R, H, or K
  MISC_FEATURE (47)..(47): Xaa is F, W, or Y
  MISC_FEATURE (48)..(48): Xaa is A, C, G, P, M, V, I, L, Sce, or Sme
  MISC_FEATURE (49)..(51): Xaa is D or E
  MISC_FEATURE (52)..(52): Xaa is A, C, G, P, M, V, I, L, Sce, or Sme
  MISC_FEATURE (53)..(53): Xaa is R, H, or K
  MISC_FEATURE (54)..(56): Xaa is A, C, G, P, M, V, I, L, Sce, or Sme
  MISC_FEATURE (57)..(58): Xaa is D or E
  MISC_FEATURE (59)..(59): Xaa is A, C, G, P, M, V, I, L, Sce, or Sme
  MISC_FEATURE (60)..(61): Xaa is S, T, N or Q
  MISC_FEATURE (62)..(62): Xaa is D or E
  MISC_FEATURE (63)..(63): Xaa is A, C, G, P, M, V, I, L, Sce, or Sme
  MISC_FEATURE (64)..(64): Xaa is F, W, or Y
  MISC_FEATURE (65)..(65): Xaa is R, H, or K
  MISC_FEATURE (66)..(68): Xaa is A, C, G, P, M, V, I, L, Sce, or Sme
  MISC_FEATURE (69)..(69): Xaa is D or E
  MISC_FEATURE (70)..(71): Xaa is A, C, G, P, M, V, I, L, Sce, or Sme
  MISC_FEATURE (72)..(72): Xaa is S, T, N or Q
  MISC_FEATURE (73)..(73): Xaa is R, H, or K
  MISC_FEATURE (74)..(74): Xaa is A, C, G, P, M, V, I, L, Sce, or Sme
  MISC_FEATURE (75)..(75): Xaa is R, H, or K
  MISC_FEATURE (76)..(76): Xaa is A, C, G, P, M, V, I, L, Sce, or Sme
  MISC_FEATURE (77)..(77): Xaa is D or E
  MISC_FEATURE (78)..(79): Xaa is A, C, G, P, M, V, I, L, Sce, or Sme
  MISC_FEATURE (80)..(80): Xaa is S, T, N or Q
  MISC_FEATURE (82)..(82): Xaa is D or E
  MISC_FEATURE (83)..(83): Xaa is R, H, or K
  MISC_FEATURE (86)..(86): Xaa is F, W, or Y
  MISC_FEATURE (87)..(87): Xaa is A, C, G, P, M, V, I, L, Sce, or Sme
  MISC_FEATURE (89)..(89): Xaa is R, H, or K
  MISC_FEATURE (90)..(90): Xaa is A, C, G, P, M, V, I, L, Sce, or Sme
  MISC_FEATURE (93)..(93): Xaa is R, H, or K
  MISC_FEATURE (94)..(94): Xaa is F, W, or Y
  MISC_FEATURE (96)..(96): Xaa is D or E
  MISC_FEATURE (97)..(98): Xaa is A, C, G, P, M, V, I, L, Sce, or Sme
  MISC_FEATURE (99)..(99): Xaa is S, T, N or Q
  MISC_FEATURE (100)..(100): Xaa is A, C, G, P, M, V, I, L, Sce, or Sme
  MISC_FEATURE (101)..(101): Xaa is R, H, or K
  MISC_FEATURE (102)..(102): Xaa is S, T, N or Q
  MISC_FEATURE (103)..(103): Xaa is F, W, or Y
  MISC_FEATURE (104)..(108): Xaa is A, C, G, P, M, V, I, L, Sce, or Sme
  MISC_FEATURE (109)..(109): Xaa is S, T, N or Q
  MISC_FEATURE (110)..(110): Xaa is A, C, G, P, M, V, I, L, Sce, or Sme
  MISC_FEATURE (111)..(111): Xaa is D or E
  MISC_FEATURE (112)..(112): Xaa is S, T, N or Q
  MISC_FEATURE (113)..(113): Xaa is A, C, G, P, M, V, I, L, Sce, or Sme
  MISC_FEATURE (114)..(114): Xaa is R, H, or K
  MISC_FEATURE (115)..(115): Xaa is A, C, G, P, M, V, I, L, Sce, or Sme
  MISC_FEATURE (116)..(116): Xaa is D or E
  MISC_FEATURE (117)..(118): Xaa is A, C, G, P, M, V, I, L, Sce, or Sme
  MISC_FEATURE (119)..(119): Xaa is R, H, or K
  MISC_FEATURE (120)..(120): Xaa is S, T, N or Q
  MISC_FEATURE (121)..(122): Xaa is A, C, G, P, M, V, I, L, Sce, or Sme
  MISC_FEATURE (123)..(124): Xaa is R, H, or K
  MISC_FEATURE (125)..(125): Xaa is A, C, G, P, M, V, I, L, Sce, or Sme
  MISC_FEATURE (127)..(128): Xaa is R, H, or K
  MISC_FEATURE (129)..(129): Xaa is A, C, G, P, M, V, I, L, Sce, or Sme
  MISC_FEATURE (131)..(131): Xaa is S, T, N or Q
  MISC_FEATURE (132)..(132): Xaa is A, C, G, P, M, V, I, L, Sce, or Sme
  MISC_FEATURE (135)..(135): Xaa is D or E
  MISC_FEATURE (136)..(136): Xaa is F, W, or Y
  MISC_FEATURE (139)..(139): Xaa is A, C, G, P, M, V, I, L, Sce, or Sme
  MISC_FEATURE (142)..(142): Xaa is A, C, G, P, M, V, I, L, Sce, or Sme
  MISC_FEATURE (145)..(145): Xaa is F, W, or Y
  MISC_FEATURE (146)..(146): Xaa is A, C, G, P, M, V, I, L, Sce, or Sme
  MISC_FEATURE (149)..(149): Xaa is A, C, G, P, M, V, I, L, Sce, or Sme
  MISC_FEATURE (150)..(150): Xaa is S, T, N or Q
  MISC_FEATURE (152)..(153): Xaa is A, C, G, P, M, V, I, L, Sce, or Sme
  MISC_FEATURE (154)..(154): Xaa is F, W, or Y
  MISC_FEATURE (155)..(157): Xaa is A, C, G, P, M, V, I, L, Sce, or Sme
  MISC_FEATURE (158)..(158): Xaa is R, H, or K
  MISC_FEATURE (159)..(160): Xaa is A, C, G, P, M, V, I, L, Sce, or Sme
  MISC_FEATURE (161)..(161): Xaa is D or E
  MISC_FEATURE (162)..(162): Xaa is A, C, G, P, M, V, I, L, Sce, or Sme
  MISC_FEATURE (163)..(163): Xaa is D or E
  MISC_FEATURE (164)..(164): Xaa is R, H, or K
  MISC_FEATURE (165)..(165): Xaa is S, T, N or Q
  MISC_FEATURE (166)..(166): Xaa is R, H, or K
  MISC_FEATURE (167)..(167): Xaa is A, C, G, P, M, V, I, L, Sce, or Sme
  MISC_FEATURE (168)..(168): Xaa is R, H, or K
  MISC_FEATURE (169)..(169): Xaa is D or E
  MISC_FEATURE (170)..(170): Xaa is A, C, G, P, M, V, I, L, Sce, or Sme
  MISC_FEATURE (171)..(171): Xaa is R, H, or K
  MISC_FEATURE (172)..(172): Xaa is S, T, N or Q

SEQ ID NO: 39 - protein, 123 aa, Artificial Sequence; identical to SEQ ID NO: 29
  Synthetic
  MISC_FEATURE (1)..(1): Xaa is any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is R, H, or K
  MISC_FEATURE (4)..(6): Xaa is A, C, G, P, M, V, I, L, Sce or Sme
  MISC_FEATURE (7)..(7): Xaa is D or E
  MISC_FEATURE (8)..(8): Xaa is A, C, G, P, M, V, I, L, Sce or Sme
  MISC_FEATURE (9)..(9): Xaa is S, T, N, or Q
  MISC_FEATURE (10)..(10): Xaa is A, C, G, P, M, V, I, L, Sce or Sme
  MISC_FEATURE (11)..(11): Xaa is S, T, N, or Q
  MISC_FEATURE (12)..(12): Xaa is A, C, G, P, M, V, I, L, Sce or Sme
  MISC_FEATURE (13)..(13): Xaa is R, H, or K
  MISC_FEATURE (14)..(14): Xaa is A, C, G, P, M, V, I, L, Sce or Sme
  MISC_FEATURE (15)..(15): Xaa is D or E
  MISC_FEATURE (16)..(17): Xaa is S, T, N, or Q
  MISC_FEATURE (18)..(19): Xaa is A, C, G, P, M, V, I, L, Sce or Sme
  MISC_FEATURE (20)..(20): Xaa is D or E
  MISC_FEATURE (21)..(22): Xaa is A, C, G, P, M, V, I, L, Sce or Sme
  MISC_FEATURE (23)..(23): Xaa is D or E
  MISC_FEATURE (24)..(24): Xaa is S, T, N, or Q
  MISC_FEATURE (25)..(25): Xaa is A, C, G, P, M, V, I, L, Sce or Sme
  MISC_FEATURE (26)..(26): Xaa is S, T, N, or Q
  MISC_FEATURE (27)..(27): Xaa is D or E
  MISC_FEATURE (29)..(29): Xaa is A, C, G, P, M, V, I, L, Sce or Sme
  MISC_FEATURE (33)..(33): Xaa is A, C, G, P, M, V, I, L, Sce or Sme
  MISC_FEATURE (35)..(35): Xaa is F, W, or Y
  MISC_FEATURE (36)..(36): Xaa is A, C, G, P, M, V, I, L, Sce or Sme
  MISC_FEATURE (37)..(37): Xaa is D or E
  MISC_FEATURE (38)..(38): Xaa is A, C, G, P, M, V, I, L, Sce or Sme
  MISC_FEATURE (39)..(39): Xaa is D or E
  MISC_FEATURE (40)..(40): Xaa is A, C, G, P, M, V, I, L, Sce or Sme
  MISC_FEATURE (41)..(41): Xaa is R, H, or K
  MISC_FEATURE (42)..(42): Xaa is S, T, N, or Q
  MISC_FEATURE (43)..(43): Xaa is R, H, or K
  MISC_FEATURE (44)..(44): Xaa is F, W, or Y
  MISC_FEATURE (45)..(45): Xaa is A, C, G, P, M, V, I, L, Sce or Sme
  MISC_FEATURE (46)..(46): Xaa is S, T, N, or Q
  MISC_FEATURE (47)..(47): Xaa is A, C, G, P, M, V, I, L, Sce or Sme
  MISC_FEATURE (48)..(48): Xaa is D or E
  MISC_FEATURE (49)..(49): Xaa is A, C, G, P, M, V, I, L, Sce or Sme
  MISC_FEATURE (50)..(50): Xaa is F, W, or Y
  MISC_FEATURE (51)..(51): Xaa is R, H, or K
  MISC_FEATURE (52)..(52): Xaa is S, T, N, or Q
  MISC_FEATURE (53)..(53): Xaa is A, C, G, P, M, V, I, L, Sce or Sme
  MISC_FEATURE (54)..(54): Xaa is S, T, N, or Q
  MISC_FEATURE (55)..(57): Xaa is A, C, G, P, M, V, I, L, Sce or Sme
  MISC_FEATURE (58)..(58): Xaa is D or E
  MISC_FEATURE (59)..(59): Xaa is R, H, or K
  MISC_FEATURE (60)..(60): Xaa is A, C, G, P, M, V, I, L, Sce or Sme
  MISC_FEATURE (61)..(61): Xaa is F, W, or Y
  MISC_FEATURE (62)..(62): Xaa is A, C, G, P, M, V, I, L, Sce or Sme
  MISC_FEATURE (63)..(63): Xaa is R, H, or K
  MISC_FEATURE (64)..(66): Xaa is A, C, G, P, M, V, I, L, Sce or Sme
  MISC_FEATURE (67)..(67): Xaa is S, T, N, or Q
  MISC_FEATURE (68)..(69): Xaa is A, C, G, P, M, V, I, L, Sce or Sme
  MISC_FEATURE (70)..(70): Xaa is D or E
  MISC_FEATURE (72)..(72): Xaa is R, H, or K
  MISC_FEATURE (77)..(77): Xaa is R, H, or K
  MISC_FEATURE (80)..(81): Xaa is A, C, G, P, M, V, I, L, Sce or Sme
  MISC_FEATURE (84)..(84): Xaa is A, C, G, P, M, V, I, L, Sce or Sme
  MISC_FEATURE (87)..(89): Xaa is A, C, G, P, M, V, I, L, Sce or Sme
  MISC_FEATURE (90)..(90): Xaa is D or E
  MISC_FEATURE (91)..(96): Xaa is A, C, G, P, M, V, I, L, Sce or Sme
  MISC_FEATURE (97)..(98): Xaa is D or E
  MISC_FEATURE (99)..(100): Xaa is A, C, G, P, M, V, I, L, Sce or Sme
  MISC_FEATURE (101)..(101): Xaa is S, T, N, or Q
  MISC_FEATURE (102)..(102): Xaa is A, C, G, P, M, V, I, L, Sce or Sme
  MISC_FEATURE (103)..(103): Xaa is S, T, N, or Q
  MISC_FEATURE (104)..(104): Xaa is A, C, G, P, M, V, I, L, Sce or Sme
  MISC_FEATURE (105)..(105): Xaa is D or E
  MISC_FEATURE (106)..(106): Xaa is A, C, G, P, M, V, I, L, Sce or Sme
  MISC_FEATURE (107)..(107): Xaa is R, H, or K
  MISC_FEATURE (108)..(108): Xaa is D or E
  MISC_FEATURE (109)..(109): Xaa is A, C, G, P, M, V, I, L, Sce or Sme
  MISC_FEATURE (110)..(110): Xaa is D or E
  MISC_FEATURE (111)..(111): Xaa is R, H, or K
  MISC_FEATURE (113)..(113): Xaa is S, T, N, or Q
  MISC_FEATURE (118)..(120): Xaa is A, C, G, P, M, V, I, L, Sce or Sme
  MISC_FEATURE (121)..(121): Xaa is R, H, or K
  MISC_FEATURE (122)..(122): Xaa is S, T, N, or Q
  MISC_FEATURE (123)..(123): Xaa is R, H, or K

SEQ ID NO: 40 - protein, 158 aa, Artificial Sequence; identical to SEQ ID NO: 30
  Synthetic
  MISC_FEATURE (1)..(1): Xaa is any amino acid or is optionally absent
  MISC_FEATURE (2)..(2): Xaa is D or E
  MISC_FEATURE (3)..(3): Xaa is S, T, N or Q
  MISC_FEATURE (4)..(4): Xaa is A, C, G, P, M, V, I, L, Selenomethionine (Sme), or Selenocysteine (Sce)
  MISC_FEATURE (5)..(7): Xaa is S, T, N or Q
  MISC_FEATURE (8)..(8): Xaa is F, W, or Y
  MISC_FEATURE (9)..(9): Xaa is A, C, G, P, M, V, I, L, Sce or Sme
  MISC_FEATURE (10)..(10): Xaa is S, T, N or Q
  MISC_FEATURE (11)..(11): Xaa is A, C, G, P, M, V, I, L, Sce or Sme
  MISC_FEATURE (12)..(12): Xaa is S, T, N or Q
  MISC_FEATURE (13)..(14): Xaa is A, C, G, P, M, V, I, L, Sce or Sme
  MISC_FEATURE (15)..(15): Xaa is S, T, N or Q
  MISC_FEATURE (16)..(16): Xaa is A, C, G, P, M, V, I, L, Sce or Sme
  MISC_FEATURE (17)..(17): Xaa is R, H, or K
  MISC_FEATURE (18)..(18): Xaa is D or E
  MISC_FEATURE (19)..(19): Xaa is F, W, or Y
  MISC_FEATURE (20)..(20): Xaa is D or E
  MISC_FEATURE (21)..(21): Xaa is S, T, N or Q
  MISC_FEATURE (22)..(22): Xaa is A, C, G, P, M, V, I, L, Sce or Sme
  MISC_FEATURE (23)..(23): Xaa is S, T, N or Q
  MISC_FEATURE (24)..(24): Xaa is F, W, or Y
  MISC_FEATURE (25)..(27): Xaa is A, C, G, P, M, V, I, L, Sce or Sme
  MISC_FEATURE (28)..(28): Xaa is R, H, or K
  MISC_FEATURE (29)..(30): Xaa is A, C, G, P, M, V, I, L, Sce or Sme
  MISC_FEATURE (31)..(31): Xaa is R, H, or K
  MISC_FEATURE (32)..(32): Xaa is S, T, N or Q
  MISC_FEATURE (33)..(33): Xaa is A, C, G, P, M, V, I, L, Sce or Sme
  MISC_FEATURE (34)..(34): Xaa is F, W, or Y
  MISC_FEATURE (35)..(36): Xaa is A, C, G, P, M, V, I, L, Sce or Sme
  MISC_FEATURE (37)..(37): Xaa is D or E
  MISC_FEATURE (38)..(38): Xaa is R, H, or K
  MISC_FEATURE (39)..(39): Xaa is A, C, G, P, M, V, I, L, Sce or Sme
  MISC_FEATURE (40)..(40): Xaa is D or E
  MISC_FEATURE (41)..(41): Xaa is A, C, G, P, M, V, I, L, Sce or Sme
  MISC_FEATURE (42)..(42): Xaa is D or E
  MISC_FEATURE (43)..(45): Xaa is A, C, G, P, M, V, I, L, Sce or Sme
  MISC_FEATURE (46)..(46): Xaa is D or E
  MISC_FEATURE (47)..(47): Xaa is R, H, or K
  MISC_FEATURE (48)..(48): Xaa is A, C, G, P, M, V, I, L, Sce or Sme
  MISC_FEATURE (51)..(51): Xaa is A, C, G, P, M, V, I, L, Sce or Sme
  MISC_FEATURE (55)..(55): Xaa is S, T, N or Q
  MISC_FEATURE (58)..(59): Xaa is A, C, G, P, M, V, I, L, Sce or Sme
  MISC_FEATURE (61)..(61): Xaa is D or E
  MISC_FEATURE (62)..(62): Xaa is S, T, N or Q
  MISC_FEATURE (63)..(64): Xaa is D or E
  MISC_FEATURE (65)..(65): Xaa is A, C, G, P, M, V, I, L, Sce or Sme
  MISC_FEATURE (66)..(66): Xaa is F, W, or Y
  MISC_FEATURE (67)..(67): Xaa is R, H, or K
  MISC_FEATURE (68)..(69): Xaa is A, C, G, P, M, V, I, L, Sce or Sme
  MISC_FEATURE (70)..(70): Xaa is R, H, or K
  MISC_FEATURE (71)..(71): Xaa is A, C, G, P, M, V, I, L, Sce or Sme
  MISC_FEATURE (72)..(72): Xaa is R, H, or K
  MISC_FEATURE (73)..(73): Xaa is A, C, G, P, M, V, I, L, Sce or Sme
  MISC_FEATURE (74)..(74): Xaa is R, H, or K
  MISC_FEATURE (75)..(76): Xaa is A, C, G, P, M, V, I, L, Sce or Sme
  MISC_FEATURE (77)..(77): Xaa is D or E
  MISC_FEATURE (78)..(78): Xaa is A, C, G, P, M, V, I, L, Sce or Sme
  MISC_FEATURE (79)..(79): Xaa is D or E
  MISC_FEATURE (80)..(80): Xaa is D or E
  MISC_FEATURE (81)..(82): Xaa is R, H, or K
  MISC_FEATURE (83)..(83): Xaa is S, T, N or Q
  MISC_FEATURE (84)..(84): Xaa is F, W, or Y
  MISC_FEATURE (85)..(85): Xaa is S, T, N or Q
  MISC_FEATURE (86)..(88): Xaa is A, C, G, P, M, V, I, L, Sce or Sme
  MISC_FEATURE (89)..(89): Xaa is F, W, or Y
  MISC_FEATURE (90)..(90): Xaa is A, C, G, P, M, V, I, L, Sce or Sme
  MISC_FEATURE (91)..(91): Xaa is D or E
  MISC_FEATURE (92)..(95): Xaa is A, C, G, P, M, V, I, L, Sce or Sme
  MISC_FEATURE (96)..(96): Xaa is S, T, N or Q
  MISC_FEATURE (97)..(98): Xaa is A, C, G, P, M, V, I, L, Sce or Sme
  MISC_FEATURE (99)..(99): Xaa is S, T, N or Q
  MISC_FEATURE (100)..(100): Xaa is D or E
  MISC_FEATURE (101)..(101): Xaa is A, C, G, P, M, V, I, L, Sce or Sme
  MISC_FEATURE (102)..(102): Xaa is D or E
  MISC_FEATURE (103)..(103): Xaa is R, H, or K
  MISC_FEATURE (104)..(104): Xaa is D or E
  MISC_FEATURE (105)..(105): Xaa is S, T, N or Q
  MISC_FEATURE (106)..(106): Xaa is A, C, G, P, M, V, I, L, Sce or Sme
  MISC_FEATURE (107)..(109): Xaa is D or E
  MISC_FEATURE (110)..(110): Xaa is A, C, G, P, M, V, I, L, Sce or Sme
  MISC_FEATURE (111)..(111): Xaa is R, H, or K
  MISC_FEATURE (114)..(114): Xaa is A, C, G, P, M, V, I, L, Sce or Sme
  MISC_FEATURE (115)..(115): Xaa is R, H, or K
  MISC_FEATURE (118)..(118): Xaa is A, C, G, P, M, V, I, L, Sce or Sme
  MISC_FEATURE (120)..(120): Xaa is A, C, G, P, M, V, I, L, Sce or Sme
  MISC_FEATURE (121)..(121): Xaa is D or E
  MISC_FEATURE (122)..(123): Xaa is A, C, G, P, M, V, I, L, Sce or Sme
  MISC_FEATURE (124)..(125): Xaa is D or E
  MISC_FEATURE (126)..(126): Xaa is R, H, or K
  MISC_FEATURE (127)..(127): Xaa is S, T, N or Q
  MISC_FEATURE (128)..(129): Xaa is A, C, G, P, M, V, I, L, Sce or Sme
  MISC_FEATURE (130)..(131): Xaa is S, T, N or Q
  MISC_FEATURE (132)..(132): Xaa is F, W, or Y
  MISC_FEATURE (133)..(133): Xaa is D or E
  MISC_FEATURE (134)..(134): Xaa is A, C, G, P, M, V, I, L, Sce or Sme
  MISC_FEATURE (135)..(135): Xaa is R, H, or K
  MISC_FEATURE (136)..(136): Xaa is A, C, G, P, M, V, I, L, Sce or Sme
  MISC_FEATURE (137)..(137): Xaa is R, H, or K
  MISC_FEATURE (138)..(139): Xaa is D or E
  MISC_FEATURE (140)..(141): Xaa is A, C, G, P, M, V, I, L, Sce or Sme
  MISC_FEATURE (142)..(143): Xaa is S, T, N or Q
  MISC_FEATURE (144)..(144): Xaa is D or E
  MISC_FEATURE (145)..(145): Xaa is S, T, N or Q
  MISC_FEATURE (146)..(146): Xaa is F, W, or Y
  MISC_FEATURE (147)..(147): Xaa is R, H, or K
  MISC_FEATURE (148)..(148): Xaa is A, C, G, P, M, V, I, L, Sce or Sme
  MISC_FEATURE (149)..(149): Xaa is D or E
  MISC_FEATURE (150)..(150): Xaa is R, H, or K
  MISC_FEATURE (151)..(152): Xaa is D or E
  MISC_FEATURE (153)..(154): Xaa is F, W, or Y
  MISC_FEATURE (155)..(155): Xaa is R, H, or K
  MISC_FEATURE (156)..(156): Xaa is D or E
  MISC_FEATURE (157)..(157): Xaa is F, W, or Y
  MISC_FEATURE (158)..(158): Xaa is A, C, G, P, M, V, I, L, Sce or Sme

SEQ ID NO: 41 - protein, 113 aa, Artificial Sequence; identical to SEQ ID NO: 31
  Synthetic
  MISC_FEATURE (1)..(1): Xaa is any amino acid or is optionally absent
  MISC_FEATURE (2)..(4): Xaa is A, C, G, P, M, V, I, L, Selenomethionine (Sme), or Selenocysteine (Sce)
  MISC_FEATURE (5)..(6): Xaa is S, T, N or Q
  MISC_FEATURE (7)..(7): Xaa is F, W, or Y
  MISC_FEATURE (8)..(8): Xaa is A, C, G, P, M, V, I, L, Sce, or Sme
  MISC_FEATURE (9)..(10): Xaa is S, T, N or Q
  MISC_FEATURE (11)..(12): Xaa is A, C, G, P, M, V, I, L, Sce, or Sme
  MISC_FEATURE (13)..(13): Xaa is D or E
  MISC_FEATURE (14)..(14): Xaa is R, H, or K
  MISC_FEATURE (16)..(17): Xaa is R, H, or K
  MISC_FEATURE (20)..(21): Xaa is A, C, G, P, M, V, I, L, Sce, or Sme
  MISC_FEATURE (24)..(24): Xaa is F, W, or Y
  MISC_FEATURE (28)..(28): Xaa is S, T, N or Q
  MISC_FEATURE (32)..(33): Xaa is A, C, G, P, M, V, I, L, Sce, or Sme
  MISC_FEATURE (34)..(34): Xaa is R, H, or K
  MISC_FEATURE (35)..(35): Xaa is A, C, G, P, M, V, I, L, Sce, or Sme
  MISC_FEATURE (37)..(37): Xaa is D or E
  MISC_FEATURE (38)..(41): Xaa is A, C, G, P, M, V, I, L, Sce, or Sme
  MISC_FEATURE (42)..(42): Xaa is S, T, N or Q
  MISC_FEATURE (43)..(43): Xaa is F, W, or Y
  MISC_FEATURE (44)..(44): Xaa is R, H, or K
  MISC_FEATURE (45)..(45): Xaa is D or E
  MISC_FEATURE (46)..(47): Xaa is S, T, N or Q
  MISC_FEATURE (48)..(49): Xaa is A, C, G, P, M, V, I, L, Sce, or Sme
  MISC_FEATURE (50)..(50): Xaa is R, H, or K
  MISC_FEATURE (51)..(52): Xaa is F, W, or Y
  MISC_FEATURE (53)..(53): Xaa is A, C, G, P, M, V, I, L, Sce, or Sme
  MISC_FEATURE (54)..(55): Xaa is S, T, N or Q
  MISC_FEATURE (56)..(56): Xaa is D or E
  MISC_FEATURE (57)..(61): Xaa is A, C, G, P, M, V, I, L, Sce, or Sme
  MISC_FEATURE (62)..(62): Xaa is R, H, or K
  MISC_FEATURE (63)..(63): Xaa is A, C, G, P, M, V, I, L, Sce, or Sme
  MISC_FEATURE (64)..(64): Xaa is D or E
  MISC_FEATURE (65)..(68): Xaa is A, C, G, P, M, V, I, L, Sce, or Sme
  MISC_FEATURE (69)..(69): Xaa is F, W, or Y
  MISC_FEATURE (70)..(71): Xaa is A, C, G, P, M, V, I, L, Sce, or Sme
  MISC_FEATURE (72)..(72): Xaa is S, T, N or Q
  MISC_FEATURE (73)..(73): Xaa is D or E
  MISC_FEATURE (74)..(74): Xaa is A, C, G, P, M, V, I, L, Sce, or Sme
  MISC_FEATURE (75)..(75): Xaa is D or E
  MISC_FEATURE (76)..(76): Xaa is R, H, or K
  MISC_FEATURE (77)..(77): Xaa is A, C, G, P, M, V, I, L, Sce, or Sme
  MISC_FEATURE (78)..(79): Xaa is S, T, N or Q
  MISC_FEATURE (81)..(81): Xaa is A, C, G, P, M, V, I, L, Sce, or Sme
  MISC_FEATURE (82)..(82): Xaa is S, T, N or Q
  MISC_FEATURE (85)..(85): Xaa is A, C, G, P, M, V, I, L, Sce, or Sme
  MISC_FEATURE (89)..(93): Xaa is A, C, G, P, M, V, I, L, Sce, or Sme
  MISC_FEATURE (94)..(94): Xaa is D or E
  MISC_FEATURE (95)..(95): Xaa is R, H, or K
  MISC_FEATURE (96)..(96): Xaa is A, C, G, P, M, V, I, L, Sce, or Sme
  MISC_FEATURE (97)..(97): Xaa is F, W, or Y
  MISC_FEATURE (98)..(99): Xaa is A, C, G, P, M, V, I, L, Sce, or Sme
  MISC_FEATURE (100)..(101): Xaa is F, W, or Y
  MISC_FEATURE (102)..(102): Xaa is S, T, N or Q
  MISC_FEATURE (103)..(104): Xaa is A, C, G, P, M, V, I, L, Sce, or Sme
  MISC_FEATURE (105)..(105): Xaa is R, H, or K
  MISC_FEATURE (106)..(107): Xaa is A, C, G, P, M, V, I, L, Sce, or Sme
  MISC_FEATURE (108)..(108): Xaa is F, W, or Y
  MISC_FEATURE (109)..(109): Xaa is S, T, N or Q
  MISC_FEATURE (110)..(110): Xaa is A, C, G, P, M, V, I, L, Sce, or Sme
  MISC_FEATURE (111)..(112): Xaa is S, T, N or Q
  MISC_FEATURE (113)..(113): Xaa is F, W, or Y

SEQ ID NO: 42 - protein, 159 aa, Artificial Sequence
  Synthetic
  MISC_FEATURE (1)..(1): Xaa is any amino acid or is optionally absent
  MISC_FEATURE (2)..(2): Xaa is A, C, G, P, M, V, I, L, Selenomethionine (Sme), or Selenocysteine (Sce)
  MISC_FEATURE (3)..(3): Xaa is D or E
  MISC_FEATURE (5)..(5): Xaa is A, C, G, P, M, V, I, L, Sme, or Sce
  MISC_FEATURE (8)..(8): Xaa is D or E
  MISC_FEATURE (9)..(9): Xaa is A, C, G, P, M, V, I, L, Sme, or Sce
  MISC_FEATURE (11)..(11): Xaa is D or E
  MISC_FEATURE (12)..(12): Xaa is A, C, G, P, M, V, I, L, Sme, or Sce
  MISC_FEATURE (13)..(13): Xaa is S, T, N, or Q
  MISC_FEATURE (17)..(17): Xaa is A, C, G, P, M, V, I, L, Sme, or Sce
  MISC_FEATURE (23)..(23): Xaa is S, T, N, or Q
  MISC_FEATURE (26)..(26): Xaa is D or E
  MISC_FEATURE (28)..(28): Xaa is D or E
  MISC_FEATURE (29)..(29): Xaa is A, C, G, P, M, V, I, L, Sme, or Sce
  MISC_FEATURE (30)..(30): Xaa is R, H, or K
  MISC_FEATURE (31)..(32): Xaa is A, C, G, P, M, V, I, L, Sme, or Sce
  MISC_FEATURE (35)..(35): Xaa is A, C, G, P, M, V, I, L, Sme, or Sce
  MISC_FEATURE (37)..(37): Xaa is S, T, N, or Q
  MISC_FEATURE (38)..(38): Xaa is A, C, G, P, M, V, I, L, Sme, or Sce
  MISC_FEATURE (43)..(43): Xaa is A, C, G, P, M, V, I, L, Sme, or Sce
  MISC_FEATURE (46)..(46): Xaa is D or E
  MISC_FEATURE (51)..(51): Xaa is R, H, or K
  MISC_FEATURE (52)..(52): Xaa is S, T, N, or Q
  MISC_FEATURE (54)..(54): Xaa is A, C, G, P, M, V, I, L, Sme, or Sce
  MISC_FEATURE (58)..(58): Xaa is A, C, G, P, M, V, I, L, Sme, or Sce
  MISC_FEATURE (59)..(59): Xaa is D or E
  MISC_FEATURE (60)..(60): Xaa is A, C, G, P, M, V, I, L, Sme, or Sce
  MISC_FEATURE (63)..(64): Xaa is A, C, G, P, M, V, I, L, Sme, or Sce
  MISC_FEATURE (65)..(65): Xaa is F, W, or Y
  MISC_FEATURE (66)..(66): Xaa is A, C, G, P, M, V, I, L, Sme, or Sce
  MISC_FEATURE (84)..(84): Xaa is S, T, N, or Q
  MISC_FEATURE (87)..(87): Xaa is A, C, G, P, M, V, I, L, Sme, or Sce
  MISC_FEATURE (91)..(92): Xaa is D or E
  MISC_FEATURE (94)..(94): Xaa is A, C, G, P, M, V, I, L, Sme, or Sce
  MISC_FEATURE (103)..(103): Xaa is D or E
  MISC_FEATURE (104)..(104): Xaa is R, H, or K
  MISC_FEATURE (106)..(107): Xaa is R, H, or K
  MISC_FEATURE (112)..(112): Xaa is A, C, G, P, M, V, I, L, Sme, or Sce
  MISC_FEATURE (126)..(126): Xaa is R, H, or K
  MISC_FEATURE (127)..(127): Xaa is S, T, N, or Q
  MISC_FEATURE (133)..(133): Xaa is A, C, G, P, M, V, I, L, Sme, or Sce
  MISC_FEATURE (135)..(136): Xaa is D or E
  MISC_FEATURE (141)..(141): Xaa is R, H, or K
  MISC_FEATURE (142)..(142): Xaa is F, W, or Y
  MISC_FEATURE (144)..(144): Xaa is D or E
  MISC_FEATURE (153)..(153): Xaa is R, H, or K
  MISC_FEATURE (155)..(155): Xaa is S, T, N, or Q
  MISC_FEATURE (157)..(157): Xaa is S, T, N, or Q
  MISC_FEATURE (158)..(158): Xaa is A, C, G, P, M, V, I, L, Sme, or Sce
  MISC_FEATURE (159)..(159): Xaa is R, H, or K
XXXVXIGXXKXXXGMEXAAVYLXPIXMXXXXXDLXAXXADIHXEAXIHALXXNXNGFXXXFWXXXXTIAYALANADTGAIKTGXLMXMVAXXGXHYGANIAMXXDXXGGFGXGTYALTFLISNPEXXGFGRHXDXXTGVGXXFXPFVVTYFFXYXGXXX

SEQ ID NO: 43 - protein, 184 aa, Artificial Sequence
  Synthetic
  MISC_FEATURE (1)..(1): Xaa is any amino acid or is optionally absent
  MISC_FEATURE (2)..(2): Xaa is S, T, N, or Q
  MISC_FEATURE (11)..(11): Xaa is S, T, N, or Q
  MISC_FEATURE (17)..(17): Xaa is A, C, G, P, M, V, I, L, Selenomethionine (Sme), or Selenocysteine (Sce)
  MISC_FEATURE (22)..(22): Xaa is A, C, G, P, M, V, I, L, Sce or Sme
  MISC_FEATURE (25)..(25): Xaa is R, H or K
  MISC_FEATURE (26)..(26): Xaa is S, T, N, or Q
  MISC_FEATURE (28)..(28): Xaa is S, T, N, or Q
  MISC_FEATURE (30)..(30): Xaa is D or E
  MISC_FEATURE (31)..(31): Xaa is A, C, G, P, M, V, I, L, Sce or Sme
  MISC_FEATURE (34)..(34): Xaa is S, T, N, or Q
  MISC_FEATURE (35)..(35): Xaa is R, H or K
  MISC_FEATURE (36)..(36): Xaa is S, T, N, or Q
  MISC_FEATURE (38)..(38): Xaa is S, T, N, or Q
  MISC_FEATURE (39)..(39): Xaa is A, C, G, P, M, V, I, L, Sce or Sme
  MISC_FEATURE (49)..(49): Xaa is D or E
  MISC_FEATURE (50)..(51): Xaa is A, C, G, P, M, V, I, L, Sce or Sme
  MISC_FEATURE (54)..(55): Xaa is S, T, N, or Q
  MISC_FEATURE (58)..(58): Xaa is D or E
  MISC_FEATURE (61)..(63): Xaa is S, T, N, or Q
  MISC_FEATURE (65)..(65): Xaa is A, C, G, P, M, V, I, L, Sce or Sme
  MISC_FEATURE (66)..(66): Xaa is D or E
  MISC_FEATURE (68)..(69): Xaa is A, C, G, P, M, V, I, L, Sce or Sme
  MISC_FEATURE (70)..(70): Xaa is D or E
  MISC_FEATURE (71)..(71): Xaa is S, T, N, or Q
  MISC_FEATURE (72)..(73): Xaa is A, C, G, P, M, V, I, L, Sce or Sme
  MISC_FEATURE (75)..(75): Xaa is A, C, G, P, M, V, I, L, Sce or Sme
  MISC_FEATURE (76)..(76): Xaa is S, T, N, or Q
  MISC_FEATURE (79)..(79): Xaa is A, C, G, P, M, V, I, L, Sce or Sme
  MISC_FEATURE (82)..(83): Xaa is A, C, G, P, M, V, I, L, Sce or Sme
  MISC_FEATURE (85)..(85): Xaa is A, C, G, P, M, V, I, L, Sce or Sme
  MISC_FEATURE (86)..(86): Xaa is S, T, N, or Q
  MISC_FEATURE (88)..(88): Xaa is A, C, G, P, M, V, I, L, Sce or Sme
  MISC_FEATURE (89)..(90): Xaa is S, T, N, or Q
  MISC_FEATURE (91)..(91): Xaa is A, C, G, P, M, V, I, L, Sce or Sme
  MISC_FEATURE (92)..(92): Xaa is D or E
  MISC_FEATURE (93)..(94): Xaa is R, H or K
  MISC_FEATURE (95)..(95): Xaa is S, T, N, or Q
  MISC_FEATURE (106)..(106): Xaa is A, C, G, P, M, V, I, L, Sce or Sme
  MISC_FEATURE (109)..(109): Xaa is A, C, G, P, M, V, I, L, Sce or Sme
  MISC_FEATURE (110)..(110): Xaa is S, T, N, or Q
  MISC_FEATURE (122)..(122): Xaa is S, T, N, or Q
  MISC_FEATURE (127)..(127): Xaa is R, H or K
  MISC_FEATURE (128)..(129): Xaa is A, C, G, P, M, V, I, L, Sce or Sme
  MISC_FEATURE (130)..(130): Xaa is F, W, or Y
  MISC_FEATURE (132)..(133): Xaa is A, C, G, P, M, V, I, L, Sce or Sme
  MISC_FEATURE (161)..(161): Xaa is R, H or K
  MISC_FEATURE (162)..(162): Xaa is A, C, G, P, M, V, I, L, Sce or Sme
  MISC_FEATURE (164)..(165): Xaa is A, C, G, P, M, V, I, L, Sce or Sme
  MISC_FEATURE (175)..(175): Xaa is D or E
  MISC_FEATURE (176)..(176): Xaa is A, C, G, P, M, V, I, L, Sce or Sme
  MISC_FEATURE (179)..(179): Xaa is R, H or K
  MISC_FEATURE (180)..(180): Xaa is S, T, N, or Q
  MISC_FEATURE (181)..(182): Xaa is A, C, G, P, M, V, I, L, Sce or Sme
  MISC_FEATURE (183)..(183): Xaa is D or E
  MISC_FEATURE (184)..(184): Xaa is A, C, G, P, M, V, I, L, Sce or Sme
XXQAIGILELXSIAKGXELGDXMLXXAXVXXLVXXXIXXGKFLLMLGGXXXAIXXAIXTGXXXAXXMXXXXXXLXXIHXSVXXAXXGXXXXXXXXAVGIVETWSVXACXXAADLAVKGSNVXLVRVXXXXGXXGKCYMVVAGDVLDVAAAVATASLAAGAXXLXXYASIIPRPHXXMWXXXXXX

SEQ ID NO: 44 - protein, 103 aa, Artificial Sequence
  Synthetic
  MISC_FEATURE (1)..(1): Xaa is any amino acid or is optionally absent
  MISC_FEATURE (24)..(25): Xaa is D or E
  MISC_FEATURE (26)..(26): Xaa is R, H, or K
  MISC_FEATURE (41)..(41): Xaa is F, W, or Y
  MISC_FEATURE (44)..(44): Xaa is S, T, N, or Q
  MISC_FEATURE (45)..(45): Xaa is A, C, G, P, M, V, I, L, Selenomethionine (Sme), or Selenocysteine (Sce)
  MISC_FEATURE (61)..(61): Xaa is S, T, N, or Q
  MISC_FEATURE (62)..(62): Xaa is R, H, or K
  MISC_FEATURE (65)..(65): Xaa is A, C, G, P, M, V, I, L, Sce, or Sme
  MISC_FEATURE (66)..(66): Xaa is R, H, or K
  MISC_FEATURE (69)..(69): Xaa is D or E
  MISC_FEATURE (70)..(70): Xaa is R, H, or K
  MISC_FEATURE (72)..(72): Xaa is R, H, or K
  MISC_FEATURE (73)..(73): Xaa is A, C, G, P, M, V, I, L, Sce, or Sme
  MISC_FEATURE (76)..(76): Xaa is A, C, G, P, M, V, I, L, Sce, or Sme
  MISC_FEATURE (77)..(77): Xaa is F, W, or Y
  MISC_FEATURE (78)..(78): Xaa is S, T, N, or Q
  MISC_FEATURE (79)..(79): Xaa is A, C, G, P, M, V, I, L, Sce, or Sme
  MISC_FEATURE (88)..(88): Xaa is A, C, G, P, M, V, I, L, Sce, or Sme
  MISC_FEATURE (89)..(89): Xaa is D or E
  MISC_FEATURE (92)..(92): Xaa is R, H, or K
  MISC_FEATURE (93)..(93): Xaa is D or E
  MISC_FEATURE (96)..(96): Xaa is D or E
  MISC_FEATURE (99)..(99): Xaa is R, H, or K
  MISC_FEATURE (100)..(100): Xaa is D or E
XEEVVLITVPSALVAVKIAHALVXXXLAACVNIVPGLTSIXRWXXSVVSDHELLLLVKTTXXAFXXLKXXVXXLHXXXXPEIVALPIXXGNXXYLXWLXXNTG

SEQ ID NO: 45 - protein, 122 aa, Artificial Sequence
  Synthetic
  MISC_FEATURE (1)..(1): Xaa is any amino acid or is optionally absent
  MISC_FEATURE (14)..(14): Xaa is D or E
  MISC_FEATURE (35)..(35): Xaa is A, C, G, P, M, V, I, L, Selenomethionine (Sme), or Selenocysteine (Sce)
  MISC_FEATURE (37)..(37): Xaa is S, T, N, or Q
  MISC_FEATURE (39)..(39): Xaa is F, W, or Y
  MISC_FEATURE (40)..(40): Xaa is D or E
  MISC_FEATURE (51)..(52): Xaa is D or E
  MISC_FEATURE (69)..(69): Xaa is R, H, or K
  MISC_FEATURE (79)..(79): Xaa is A, C, G, P, M, V, I, L, Sce, Sme
  MISC_FEATURE (81)..(82): Xaa is A, C, G, P, M, V, I, L, Sce, Sme
  MISC_FEATURE (85)..(85): Xaa is A, C, G, P, M, V, I, L, Sce, Sme
  MISC_FEATURE (86)..(86): Xaa is R, H, or K
  MISC_FEATURE (97)..(97): Xaa is D or E
  MISC_FEATURE (99)..(99): Xaa is A, C, G, P, M, V, I, L, Sce, Sme
  MISC_FEATURE (101)..(101): Xaa is D or E
  MISC_FEATURE (102)..(102): Xaa is R, H, or K
  MISC_FEATURE (104)..(104): Xaa is R, H, or K
  MISC_FEATURE (110)..(110): Xaa is D or E
  MISC_FEATURE (112)..(112): Xaa is A, C, G, P, M, V, I, L, Sce, Sme
  MISC_FEATURE (113)..(113): Xaa is R, H, or K
  MISC_FEATURE (116)..(116): Xaa is A, C, G, P, M, V, I, L, Sce, Sme
  MISC_FEATURE (117)..(117): Xaa is D or E
  MISC_FEATURE (118)..(118): Xaa is A, C, G, P, M, V, I, L, Sce, Sme
  MISC_FEATURE (119)..(119): Xaa is D or E
  MISC_FEATURE (120)..(120): Xaa is S, T, N, or Q
  MISC_FEATURE (121)..(121): Xaa is A, C, G, P, M, V, I, L, Sce, Sme
  MISC_FEATURE (122)..(122): Xaa is S, T, N, or Q
XVRGIRGAITVEEXTPAAILAATIELLLKMLEANXIXSXXELAAVIFTVTXXLTSAFPAEAARLIGMHXVPLLSAREVXVXXSLXXVIRVLALWNTXTXQXXVXHVYLNXAXXLRXXXXXXX

SEQ ID NO: 46 - protein, 177 aa, Artificial Sequence
  Synthetic
  MISC_FEATURE (1)..(1): Xaa is any amino acid or optionally absent
  MISC_FEATURE (2)..(2): Xaa is S, T, N or Q
  MISC_FEATURE (3)..(3): Xaa is R, H or K
  MISC_FEATURE (16)..(16): Xaa is S, T, N or Q
  MISC_FEATURE (17)..(19): Xaa is A, C, G, P, M, V, I, L, Selenomethionine (Sme), or Selenocysteine (Sce)
  MISC_FEATURE (20)..(20): Xaa is S, T, N or Q
  MISC_FEATURE (21)..(21): Xaa is A, C, G, P, M, V, I, L, Sce, or Sme
  MISC_FEATURE (37)..(37): Xaa is S, T, N or Q
  MISC_FEATURE (39)..(39): Xaa is D or E
  MISC_FEATURE (42)..(42): Xaa is A, C, G, P, M, V, I, L, Sce, or Sme
  MISC_FEATURE (44)..(44): Xaa is F, W, or Y
  MISC_FEATURE (45)..(45): Xaa is S, T, N or Q
  MISC_FEATURE (51)..(51): Xaa is S, T, N or Q
  MISC_FEATURE (52)..(52): Xaa is D or E
  MISC_FEATURE (53)..(53): Xaa is A, C, G, P, M, V, I, L, Sce, or Sme
  MISC_FEATURE (56)..(56): Xaa is S, T, N or Q
  MISC_FEATURE (59)..(59): Xaa is A, C, G, P, M, V, I, L, Sce, or Sme
  MISC_FEATURE (63)..(64): Xaa is D or E
  MISC_FEATURE (65)..(65): Xaa is S, T, N or Q
  MISC_FEATURE (66)..(66): Xaa is D or E
  MISC_FEATURE (80)..(81): Xaa is R, H or K
  MISC_FEATURE (89)..(89): Xaa is D or E
  MISC_FEATURE (90)..(90): Xaa is A, C, G, P, M, V, I, L, Sce, or Sme
  MISC_FEATURE (93)..(93): Xaa is D or E
  MISC_FEATURE (95)..(95): Xaa is A, C, G, P, M, V, I, L, Sce, or Sme
  MISC_FEATURE (105)..(105): Xaa is A, C, G, P, M, V, I, L, Sce, or Sme
  MISC_FEATURE (106)..(106): Xaa is D or E
  MISC_FEATURE (108)..(108): Xaa is A, C, G, P, M, V, I, L, Sce, or Sme
  MISC_FEATURE (109)..(109): Xaa is R, H or K
  MISC_FEATURE (110)..(110): Xaa is D or E
  MISC_FEATURE (124)..(124): Xaa is R, H or K
  MISC_FEATURE (126)..(126): Xaa is D or E
  MISC_FEATURE (135)..(135): Xaa is D or E
  MISC_FEATURE (152)..(152): Xaa is F, W, or Y
  MISC_FEATURE (156)..(156): Xaa is A, C, G, P, M, V, I, L, Sce, or Sme
  MISC_FEATURE (158)..(158): Xaa is D or E
  MISC_FEATURE (161)..(161): Xaa is F, W, or Y
  MISC_FEATURE (165)..(165): Xaa is S, T, N or Q
  MISC_FEATURE (166)..(166): Xaa is D or E
  MISC_FEATURE (170)..(170): Xaa is R, H or K
  MISC_FEATURE (173)..(173): Xaa is R, H or K
  MISC_FEATURE (174)..(174): Xaa is A, C, G, P, M, V, I, L, Sce, or Sme
  MISC_FEATURE (175)..(175): Xaa is R, H or K
  MISC_FEATURE (176)..(176): Xaa is A, C, G, P, M, V, I, L, Sce, or Sme
  MISC_FEATURE (177)..(177): Xaa is R, H or K
XXXAKIGIVTVSDRAXXXXXXDISGKAIILALNLYLXSXWEXIXXVIPDEXXXIEXTLXKMAXXXXCCLIVTTGGTGPAXXDVTPEATXXVCXRXMPGFGELMRXXSXXXVPTAILSRQTAGLXGXSLIVNLPGXPASISDCLLAVFPAIPXCIDXMXGPXLECXXAMIXPFXXXXX

SEQ ID NO: 47 - protein, 122 aa, Artificial Sequence
  Synthetic
  MISC_FEATURE (1)..(1): Xaa is any amino acid or is optionally absent
  MISC_FEATURE (14)..(14): Xaa is D or E
  MISC_FEATURE (32)..(32): Xaa is D or E
  MISC_FEATURE (33)..(33): Xaa is A, C, G, P, M, V, I, L, Selenomethionine (Sme), or Selenocysteine (Sce)
  MISC_FEATURE (35)..(35): Xaa is A, C, G, P, M, V, I, L, Sce, or Sme
  MISC_FEATURE (37)..(37): Xaa is S, T, N, or Q
  MISC_FEATURE (39)..(39): Xaa is F, W, or Y
  MISC_FEATURE (41)..(41): Xaa is D or E
  MISC_FEATURE (51)..(52): Xaa is D or E
  MISC_FEATURE (57)..(57): Xaa is F, W, or Y
  MISC_FEATURE (68)..(68): Xaa is R, H, or K
  MISC_FEATURE (79)..(79): Xaa is A, C, G, P, M, V, I, L, Sce, or Sme
  MISC_FEATURE (81)..(82): Xaa is A, C, G, P, M, V, I, L, Sce, or Sme
  MISC_FEATURE (85)..(85): Xaa is A, C, G, P, M, V, I, L, Sce, or Sme
  MISC_FEATURE (86)..(86): Xaa is R, H, or K
  MISC_FEATURE (97)..(97): Xaa is D or E
  MISC_FEATURE (99)..(99): Xaa is A, C, G, P, M, V, I, L, Sce, or Sme
  MISC_FEATURE (101)..(101): Xaa is D or E
  MISC_FEATURE (102)..(102): Xaa is R, H, or K
  MISC_FEATURE (104)..(105): Xaa is R, H, or K
  MISC_FEATURE (107)..(107): Xaa is F, W, or Y
  MISC_FEATURE (112)..(112): Xaa is A, C, G, P, M, V, I, L, Sce, or Sme
  MISC_FEATURE (113)..(113): Xaa is R, H, or K
  MISC_FEATURE (114)..(114): Xaa is A, C, G, P, M, V, I, L, Sce, or Sme
  MISC_FEATURE (115)..(115): Xaa is R, H, or K
  MISC_FEATURE (116)..(116): Xaa is A, C, G, P, M, V, I, L, Sce, or Sme
  MISC_FEATURE (117)..(117): Xaa is D or E
  MISC_FEATURE (118)..(118): Xaa is A, C, G, P, M, V, I, L, Sce, or Sme
  MISC_FEATURE (119)..(119): Xaa is D or E
  MISC_FEATURE (120)..(120): Xaa is S, T, N, or Q
  MISC_FEATURE (121)..(121): Xaa is A, C, G, P, M, V, I, L, Sce, or Sme
  MISC_FEATURE (122)..(122): Xaa is S, T, N, or Q
XVRGIRGAITVNSXTPTSIIIATILLLEKMLXXNXIXSXEXLAAVIFTVTXXLTSAXPAEAARQIGMXRVPLLSAREVXVXXSLXXVIRVLALWNTXTXQXXVXXVXLSEAXXXXXXXXXXX

SEQ ID NO: 48 - protein, 172 aa, Artificial Sequence
  Synthetic
  MISC_FEATURE (1)..(1): Xaa is any amino acid or is optionally absent
  MISC_FEATURE (2)..(2): Xaa is R, H or K
  MISC_FEATURE (3)..(3): Xaa is A, C, G, P, M, V, I, L, Selenomethionine (Sme), or Selenocysteine (Sce)
  MISC_FEATURE (4)..(5): Xaa is S, T, N or Q
  MISC_FEATURE (6)..(6): Xaa is R, H or K
  MISC_FEATURE (7)..(8): Xaa is A, C, G, P, M, V, I, L, Sce, or Sme
  MISC_FEATURE (9)..(9): Xaa is D or E
  MISC_FEATURE (10)..(10): Xaa is R, H or K
  MISC_FEATURE (11)..(11): Xaa is A, C, G, P, M, V, I, L, Sce, or Sme
  MISC_FEATURE (12)..(13): Xaa is S, T, N or Q
  MISC_FEATURE (14)..(14): Xaa is R, H or K
  MISC_FEATURE (15)..(15): Xaa is A, C, G, P, M, V, I, L, Sce, or Sme
  MISC_FEATURE (16)..(16): Xaa is F, W or Y
  MISC_FEATURE (17)..(18): Xaa is A, C, G, P, M, V, I, L, Sce, or Sme
  MISC_FEATURE (19)..(20): Xaa is D or E
  MISC_FEATURE (21)..(21): Xaa is A, C, G, P, M, V, I, L, Sce, or Sme
  MISC_FEATURE (22)..(22): Xaa is F, W or Y
  MISC_FEATURE (24)..(24): Xaa is D or E
  MISC_FEATURE (25)..(25): Xaa is S, T, N or Q
  MISC_FEATURE (28)..(28): Xaa is A, C, G, P, M, V, I, L, Sce, or Sme
  MISC_FEATURE (29)..(29): Xaa is D or E
  MISC_FEATURE (46)..(46): Xaa is R, H or K
  MISC_FEATURE (49)..(51): Xaa is D or E
  MISC_FEATURE (53)..(53): Xaa is R, H or K
  MISC_FEATURE (58)..(58): Xaa is D or E
  MISC_FEATURE (64)..(64): Xaa is F, W or Y
  MISC_FEATURE (73)..(73): Xaa is R, H or K
  MISC_FEATURE (75)..(75): Xaa is R, H or K
  MISC_FEATURE (76)..(76): Xaa is A, C, G, P, M, V, I, L, Sce, or Sme
  MISC_FEATURE (77)..(77): Xaa is D or E
  MISC_FEATURE (80)..(80): Xaa is S, T, N or Q
  MISC_FEATURE (82)..(82): Xaa is D or E
  MISC_FEATURE (83)..(83): Xaa is R, H or K
  MISC_FEATURE (89)..(89): Xaa is R, H or K
  MISC_FEATURE (93)..(93): Xaa is R, H or K
  MISC_FEATURE (96)..(96): Xaa is D or E
  MISC_FEATURE (97)..(97): Xaa is A, C, G, P, M, V, I, L, Sce, or Sme
  MISC_FEATURE (99)..(99): Xaa is S, T, N or Q
  MISC_FEATURE (100)..(100): Xaa is A, C, G, P, M, V, I, L, Sce, or Sme
  MISC_FEATURE (101)..(101): Xaa is R, H or K
  MISC_FEATURE (102)..(102): Xaa is S, T, N or Q
  MISC_FEATURE (103)..(103): Xaa is F, W or Y
  MISC_FEATURE (104)..(104): Xaa is A, C, G, P, M, V, I, L, Sce, or Sme
  MISC_FEATURE (111)..(111): Xaa is D or E
  MISC_FEATURE (123)..(123): Xaa is R, H or K
  MISC_FEATURE (131)..(131): Xaa is S, T, N or Q
  MISC_FEATURE (135)..(135): Xaa is D or E
  MISC_FEATURE (136)..(136): Xaa is F, W or Y
  MISC_FEATURE (154)..(154): Xaa is F, W or Y
  MISC_FEATURE (162)..(162): Xaa is A, C, G, P, M, V, I, L, Sce, or Sme
  MISC_FEATURE (163)..(163): Xaa is D or E
  MISC_FEATURE (164)..(164): Xaa is R, H or K
  MISC_FEATURE (165)..(165): Xaa is S, T, N or Q
  MISC_FEATURE (166)..(166): Xaa is R, H or K
  MISC_FEATURE (167)..(167): Xaa is A, C, G, P, M, V, I, L, Sce, or Sme
  MISC_FEATURE (168)..(168): Xaa is R, H or K
  MISC_FEATURE (169)..(169): Xaa is D or E
  MISC_FEATURE (170)..(170): Xaa is A, C, G, P, M, V, I, L, Sce, or Sme
  MISC_FEATURE (171)..(171): Xaa is R, H or K
  MISC_FEATURE (172)..(172): Xaa is S, T, N or Q
XXXXXXXXXXXXXXXXXXXXXXKXXPIXXANGTLDELTSFIGEAKXYVXXXMXGILEXIQNDIXKIMGEIGSXGXXXGIXEXXIAWLLXLILXYMXXVXXXXXXLPGGTLXSAKLDVCRTIAXRALRKVLXVTRXXGIGAEAAAYLLALSDLLXLLARVIEXXXXXXXXXXX

SEQ ID NO: 49 - protein, 123 aa, Artificial Sequence
  Synthetic
  MISC_FEATURE (1)..(1): Xaa is any amino acid or is optionally absent
  MISC_FEATURE (13)..(13): Xaa is R, H, or K
  MISC_FEATURE (15)..(15): Xaa is D or E
  MISC_FEATURE (17)..(108): Xaa is S, T, N or Q
  MISC_FEATURE (20)..(20): Xaa is D or E
  MISC_FEATURE (24)..(24): Xaa is S, T, N or Q
  MISC_FEATURE (33)..(33): Xaa is A, C, G, P, M, V, I, L, Selenomethionine (Sme), or Selenocysteine (Sce)
  MISC_FEATURE (39)..(39): Xaa is D or E
  MISC_FEATURE (42)..(42): Xaa is S, T, N or Q
  MISC_FEATURE (43)..(43): Xaa is R, H, or K
  MISC_FEATURE (46)..(46): Xaa is S, T, N or Q
  MISC_FEATURE (48)..(48): Xaa is D or E
  MISC_FEATURE (51)..(51): Xaa is R, H, or K
  MISC_FEATURE (54)..(54): Xaa is S, T, N or Q
  MISC_FEATURE (56)..(57): Xaa is A, C, G, P, M, V, I, L, Sce, or Sme
  MISC_FEATURE (58)..(58): Xaa is D or E
  MISC_FEATURE (70)..(70): Xaa is D or E
  MISC_FEATURE (72)..(72): Xaa is R, H, or K
  MISC_FEATURE (90)..(90): Xaa is D or E
  MISC_FEATURE (97)..(98): Xaa is D or E
  MISC_FEATURE (108)..(108): Xaa is D or E
  MISC_FEATURE (111)..(111): Xaa is R, H, or K
  MISC_FEATURE (118)..(120): Xaa is A, C, G, P, M, V, I, L, Sce, or Sme
  MISC_FEATURE (121)..(121): Xaa is R, H, or K
  MISC_FEATURE (122)..(122): Xaa is S, T, N or Q
  MISC_FEATURE (123)..(123): Xaa is R, H, or K
XPHLVIEATANLXLXTXPGXLLEXANKSLFASXQFGEAXIKXXFVXLXAYXQGXAXXXRAYLHACLSILXGXDIATRTLLGASLCAVLAXAVAGGGXXGVQVSVEVRXMEXLSYAKRXXXXXX

SEQ ID NO: 50 - protein, 158 aa, Artificial Sequence
  Synthetic
  MISC_FEATURE (1)..(1): Xaa is any amino acid or is optionally absent
  MISC_FEATURE (2)..(2): Xaa is D or E
  MISC_FEATURE (3)..(3): Xaa is S, T, N or Q
  MISC_FEATURE (4)..(4): Xaa is A, C, G, P, M, V, I, L, Selenomethionine (Sme), or Selenocysteine (Sce)
  MISC_FEATURE (19)..(19): Xaa is F, W, or Y
  MISC_FEATURE (20)..(20): Xaa is D or E
  MISC_FEATURE (21)..(21): Xaa is S, T, N or Q
  MISC_FEATURE (30)..(30): Xaa is A, C, G, P, M, V, I, L, Sce, Sme
  MISC_FEATURE (31)..(31): Xaa is R, H, or K
  MISC_FEATURE (38)..(38): Xaa is R, H, or K
  MISC_FEATURE (45)..(45): Xaa is A, C, G, P, M, V, I, L, Sce, Sme
  MISC_FEATURE (46)..(46): Xaa is D or E
  MISC_FEATURE (62)..(62): Xaa is S, T, N or Q
  MISC_FEATURE (63)..(64): Xaa is D or E
  MISC_FEATURE (65)..(65): Xaa is A, C, G, P, M, V, I, L, Sce, Sme
  MISC_FEATURE (67)..(67): Xaa is R, H, or K
  MISC_FEATURE (79)..(79): Xaa is D or E
  MISC_FEATURE (82)..(82): Xaa is R, H, or K
  MISC_FEATURE (83)..(83): Xaa is S, T, N or Q
  MISC_FEATURE (84)..(84): Xaa is F, W, or Y
  MISC_FEATURE (87)..(87): Xaa is A, C, G, P, M, V, I, L, Sce, Sme
  MISC_FEATURE (89)..(89): Xaa is F, W, or Y
  MISC_FEATURE (94)..(95): Xaa is A, C, G, P, M, V, I, L, Sce, Sme
  MISC_FEATURE (96)..(96): Xaa is S, T, N or Q
  MISC_FEATURE (97)..(98): Xaa is A, C, G, P, M, V, I, L, Sce, Sme
  MISC_FEATURE (99)..(99): Xaa is S, T, N or Q
  MISC_FEATURE (100)..(100): Xaa is D or E
  MISC_FEATURE (101)..(101): Xaa is A, C, G, P, M, V, I, L, Sce, Sme
  MISC_FEATURE (102)..(102): Xaa is D or E
  MISC_FEATURE (103)..(103): Xaa is R, H, or K
  MISC_FEATURE (104)..(104): Xaa is D or E
  MISC_FEATURE (105)..(105): Xaa is S, T, N or Q
  MISC_FEATURE (109)..(109): Xaa is D or E
  MISC_FEATURE (115)..(115): Xaa is R, H, or K
  MISC_FEATURE (121)..(121): Xaa is D or E
  MISC_FEATURE (123)..(123): Xaa is A, C, G, P, M, V, I, L, Sce, Sme
  MISC_FEATURE (125)..(125): Xaa is D or E
  MISC_FEATURE (126)..(126): Xaa is R, H, or K
  MISC_FEATURE (127)..(127): Xaa is S, T, N or Q
  MISC_FEATURE (133)..(133): Xaa is D or E
  MISC_FEATURE (134)..(134): Xaa is A, C, G, P, M, V, I, L, Sce, Sme
  MISC_FEATURE (136)..(136): Xaa is A, C, G, P, M, V, I, L, Sce, Sme
  MISC_FEATURE (137)..(137): Xaa is R, H, or K
  MISC_FEATURE (138)..(139): Xaa is D or E
  MISC_FEATURE (140)..(141): Xaa is A, C, G, P, M, V, I, L, Sce, Sme
  MISC_FEATURE (142)..(142): Xaa is S, T, N or Q
  MISC_FEATURE (145)..(145): Xaa is S, T, N or Q
  MISC_FEATURE (147)..(147): Xaa is R, H, or K
  MISC_FEATURE (151)..(152): Xaa is D or E
  MISC_FEATURE (155)..(155): Xaa is R, H, or K
  MISC_FEATURE (156)..(156): Xaa is D or E
  MISC_FEATURE (157)..(157): Xaa is F, W, or Y
  MISC_FEATURE (158)..(158): Xaa is A, C, G, P, M, V, I, L, Sce, Sme
XXXXNTSFLSPSLVTIRDXXXGQFAVLRIXXTGFPADXGDIDLCXXKMIGVRAAQIFLGDDXXXXFXGPHIRIRCVDIXDKXXXNAXVXVDLIXXXXXXXXXXXXAEEXAKLALXVALQVXIXDXXXCVTQFXXKXXXXXXXSDXFXPDKXXYYXXXX

SEQ ID NO: 51 - protein, 113 aa, Artificial Sequence
  Synthetic
  MISC_FEATURE (1)..(1): Xaa is any amino acid or is optionally absent
  MISC_FEATURE (11)..(11): Xaa is A, C, G, P, M, V, I, L, Selenomethionine (Sme), or Selenocysteine (Sce)
  MISC_FEATURE (13)..(13): Xaa is D or E
  MISC_FEATURE (14)..(14): Xaa is R, H, or K
  MISC_FEATURE (16)..(17): Xaa is R, H, or K
  MISC_FEATURE (33)..(33): Xaa is A, C, G, P, M, V, I, L, Sce, or Sme
  MISC_FEATURE (35)..(35): Xaa is A, C, G, P, M, V, I, L, Sce, or Sme
  MISC_FEATURE (45)..(45): Xaa is D or E
  MISC_FEATURE (46)..(46): Xaa is S, T, N or Q
  MISC_FEATURE (55)..(55): Xaa is S, T, N or Q
  MISC_FEATURE (56)..(56): Xaa is D or E
  MISC_FEATURE (57)..(57): Xaa is A, C, G, P, M, V, I, L, Sce, or Sme
  MISC_FEATURE (66)..(67): Xaa is A, C, G, P, M, V, I, L, Sce, or Sme
  MISC_FEATURE (69)..(69): Xaa is F, W, or Y
  MISC_FEATURE (71)..(71): Xaa is A, C, G, P, M, V, I, L, Sce, or Sme
  MISC_FEATURE (72)..(72): Xaa is S, T, N or Q
  MISC_FEATURE (75)..(75): Xaa is D or E
  MISC_FEATURE (90)..(90): Xaa is A, C, G, P, M, V, I, L, Sce, or Sme
  MISC_FEATURE (92)..(92): Xaa is A, C, G, P, M, V, I, L, Sce, or Sme
  MISC_FEATURE (94)..(94): Xaa is D or E
  MISC_FEATURE (102)..(102): Xaa is S, T, N or Q
  MISC_FEATURE (104)..(104): Xaa is A, C, G, P, M, V, I, L, Sce, or Sme
  MISC_FEATURE (108)..(108): Xaa is F, W, or Y
  MISC_FEATURE (111)..(112): Xaa is S, T, N or Q
  MISC_FEATURE (113)..(113): Xaa is F, W, or Y
XPVIQTFVSTXLXXHXXLLLAIIYRIVTRVVLXKXEDLVMMTFHXXTPMHFFGSXXXVACVRVEAXXGXGXXEPXKVTSIVTAAITAVCXIXAXRIFVLYFXPXHCGXNGXXX

SEQ ID NO: 52 - protein, 16 aa, Artificial Sequence
  Synthetic
  MISC_FEATURE (1)..(1): optionally absent
MGCVQCKDKEATKLTE

SEQ ID NO: 53 - protein, 16 aa, Artificial Sequence
  Synthetic
  MISC_FEATURE (1)..(1): optionally absent
MGCIKSKRKDNLNDDE

SEQ ID NO: 54 - protein, 16 aa, Artificial Sequence
  Synthetic
  MISC_FEATURE (1)..(1): optionally absent
MGCVCSSNPEDDWMEN

SEQ ID NO: 55 - protein, 16 aa, Artificial Sequence
  Synthetic
  MISC_FEATURE (1)..(1): optionally absent
MGCMKSKFLQVGGNTG

SEQ ID NO: 56 - protein, 16 aa, Artificial Sequence
  Synthetic
  MISC_FEATURE (1)..(1): optionally absent
MGCVFCKKLEPVATAK

SEQ ID NO: 57 - protein, 16 aa, Artificial Sequence
  Synthetic
  MISC_FEATURE (1)..(1): optionally absent
MGCVHCKEKISGKGQG

SEQ ID NO: 58 - protein, 16 aa, Artificial Sequence
  Synthetic
  MISC_FEATURE (1)..(1): optionally absent
MGLLSSKRQVSEKGKG

SEQ ID NO: 59 - protein, 16 aa, Artificial Sequence
  Synthetic
  MISC_FEATURE (1)..(1): optionally absent
MGQQPGKVLGDQRRPS

SEQ ID NO: 60 - protein, 16 aa, Artificial Sequence
  Synthetic
  MISC_FEATURE (1)..(1): optionally absent
MGQQVGRVGEAPGLQQ

SEQ ID NO: 61 - protein, 16 aa, Artificial Sequence
  Synthetic
  MISC_FEATURE (1)..(1): optionally absent
MGNAAAAKKGSEQESV

SEQ ID NO: 62 - protein, 16 aa, Artificial Sequence
  Synthetic
  MISC_FEATURE (1)..(1): optionally absent
MGNAATAKKGSEVESV

SEQ ID NO: 63 - protein, 16 aa, Artificial Sequence
  Synthetic
  MISC_FEATURE (1)..(1): optionally absent
MGAQLSLVVQASPSIA

SEQ ID NO: 64 - protein, 16 aa, Artificial Sequence
  Synthetic
  MISC_FEATURE (1)..(1): optionally absent
MGHALCVCSRGTVIID

SEQ ID NO: 65 - protein, 16 aa, Artificial Sequence
  Synthetic
  MISC_FEATURE (1)..(1): optionally absent
MGQLCCFPFSRDEGKI

SEQ ID NO: 66 - protein, 16 aa, Artificial Sequence
  Synthetic
  MISC_FEATURE (1)..(1): optionally absent
MGNEASYPLEMCSHFD

SEQ ID NO: 67 - protein, 16 aa, Artificial Sequence
  Synthetic
  MISC_FEATURE (1)..(1): optionally absent
MGNSGSKQHTKHNSKK

SEQ ID NO: 68 - protein, 16 aa, Artificial Sequence
  Synthetic
  MISC_FEATURE (1)..(1): optionally absent
MGCTLSAEDKAAVERS

SEQ ID NO: 69 - protein, 16 aa, Artificial Sequence
  Synthetic
  MISC_FEATURE (1)..(1): optionally absent
MGCTLSAEERAALERS

SEQ ID NO: 70 - protein, 16 aa, Artificial Sequence
  Synthetic
  MISC_FEATURE (1)..(1): optionally absent
MGAGASAEEKHSRELE

SEQ ID NO: 71 - protein, 16 aa, Artificial Sequence
  Synthetic
  MISC_FEATURE (1)..(1): optionally absent
MGCRQSSEEKEAARRS

SEQ ID NO: 72 - protein, 16 aa, Artificial Sequence
  Synthetic
  MISC_FEATURE (1)..(1): optionally absent
MGLSFTKLFSRLFAKK

SEQ ID NO: 73 - protein, 16 aa, Artificial Sequence
  Synthetic
  MISC_FEATURE (1)..(1): optionally absent
MGNIFGNLLKSLIGKK

SEQ ID NO: 74 - protein, 16 aa, Artificial Sequence
  Synthetic
  MISC_FEATURE (1)..(1): optionally absent
MGLTVSALFSRIFGKK

SEQ ID NO: 75 - protein, 16 aa, Artificial Sequence
  Synthetic
  MISC_FEATURE (1)..(1): optionally absent
MGKVLSKIFGNKEMRI

SEQ ID NO: 76 - protein, 16 aa, Artificial Sequence
  Synthetic
  MISC_FEATURE (1)..(1): optionally absent
MGNSKSGALSKEILEE

SEQ ID NO: 77 - protein, 16 aa, Artificial Sequence
  Synthetic
  MISC_FEATURE (1)..(1): optionally absent
MGKQNSKLRPEVMQDL

SEQ ID NO: 78 - protein, 16 aa, Artificial Sequence
  Synthetic
  MISC_FEATURE (1)..(1): optionally absent
MGKRASKLKPEEVEEL

SEQ ID NO: 79 - protein, 16 aa, Artificial Sequence
  Synthetic
  MISC_FEATURE (1)..(1): optionally absent
MGKQNSKLRPEVLQDL

SEQ ID NO: 80 - protein, 16 aa, Artificial Sequence
  Synthetic
  MISC_FEATURE (1)..(1): optionally absent
MGSRASTLLRDEELEE

SEQ ID NO: 81 - protein, 16 aa, Artificial Sequence
  Synthetic
  MISC_FEATURE (1)..(1): optionally absent
MGSKLSKKKKGYNVND

SEQ ID NO: 82 - protein, 16 aa, Artificial Sequence
  Synthetic
  MISC_FEATURE (1)..(1): optionally absent
MGKQNSKLRPEMLQDL

SEQ ID NO: 83 - protein, 16 aa, Artificial Sequence
  Synthetic
  MISC_FEATURE (1)..(1): optionally absent
MGNVMEGKSVEELSST

SEQ ID NO: 84 - protein, 16 aa, Artificial Sequence
  Synthetic
  MISC_FEATURE (1)..(1): optionally absent
MGQQFSWEEAEENGAV

SEQ ID NO: 85 - protein, 16 aa, Artificial Sequence
  Synthetic
  MISC_FEATURE (1)..(1): optionally absent
MGNTKSGALSKEILEE

SEQ ID NO: 86 - protein, 16 aa, Artificial Sequence
  Synthetic
  MISC_FEATURE (1)..(1): optionally absent
MGKQNSKLRPEVLQDL

SEQ ID NO: 87 - protein, 16 aa, Artificial Sequence
  Synthetic
  MISC_FEATURE (1)..(1): optionally absent
MGAQFSKTAAKGEATA

SEQ ID NO: 88 - protein, 16 aa, Artificial Sequence
  Synthetic
  MISC_FEATURE (1)..(1): optionally absent
MGSQSSKAPRGDVTAE

SEQ ID NO: 89 - protein, 16 aa, Artificial Sequence
  Synthetic
  MISC_FEATURE (1)..(1): optionally absent
MGNRHAKASSPQGFDV

SEQ ID NO: 90 - protein, 16 aa, Artificial Sequence
  Synthetic
  MISC_FEATURE (1)..(1): optionally absent
MGQDQTKQQIEKGLQL

SEQ ID NO: 91 - protein, 16 aa, Artificial Sequence
  Synthetic
  MISC_FEATURE (1)..(1): optionally absent
MGQALSIKSCDFHAAE

SEQ ID NO: 92 - protein, 16 aa, Artificial Sequence
  Synthetic
  MISC_FEATURE (1)..(1): optionally absent
MGNRAFKAHNGHYLSA

SEQ ID NO: 93 - protein, 16 aa, Artificial Sequence
  Synthetic
  MISC_FEATURE (1)..(1): optionally absent
MGARASVLSGGELDRW

SEQ ID NO: 94 - protein, 16 aa, Artificial Sequence
  Synthetic
  MISC_FEATURE (1)..(1): optionally absent
MGQTVTTPLSLTLDHW

SEQ ID NO: 95 - protein, 16 aa, Artificial Sequence
  Synthetic
  MISC_FEATURE (1)..(1): optionally absent
MGQAVTTPLSLTLDHW

SEQ ID NO: 96 - protein, 16 aa, Artificial Sequence
  Synthetic
  MISC_FEATURE (1)..(1): optionally absent
MGNSPSYNPPAGISPS

SEQ ID NO: 97 - protein, 16 aa, Artificial Sequence
  Synthetic
  MISC_FEATURE (1)..(1): optionally absent
MGQTLTTPLSLTLTHF

SEQ ID NO: 98 - protein, 16 aa, Artificial Sequence
  Synthetic
  MISC_FEATURE (1)..(1): optionally absent
MGQTITTPLSLTLDHW

SEQ ID NO: 99 - protein, 16 aa, Artificial Sequence
  Synthetic
  MISC_FEATURE (1)..(1): optionally absent
MGQTVTTPLSLTLEHW

SEQ ID NO: 100 - protein, 16 aa, Artificial Sequence
  Synthetic
  MISC_FEATURE (1)..(1): optionally absent
MGQELSQHERYVEQLK

SEQ ID NO: 101 - protein, 16 aa, Artificial Sequence
  Synthetic
  MISC_FEATURE (1)..(1): optionally absent
MGVSGSKGQKLFVSVL

SEQ ID NO: 102 - protein, 16 aa, Artificial Sequence
  Synthetic
  MISC_FEATURE (1)..(1): optionally absent
MGGKWSKSSVVGWPTV

SEQ ID NO: 103 - protein, 16 aa, Artificial Sequence
  Synthetic
  MISC_FEATURE (1)..(1): optionally absent
MGQHPAKSMDVRRIEG

SEQ ID NO: 104 - protein, 16 aa, Artificial Sequence
  Synthetic
  MISC_FEATURE (1)..(1): optionally absent
MGAQVSRQNVGTHSTQ

SEQ ID NO: 105 - protein, 16 aa, Artificial Sequence
  Synthetic
  MISC_FEATURE (1)..(1): optionally absent
MGLAFSGARPCCCRHN

SEQ ID NO: 106 - protein, 16 aa, Artificial Sequence
  Synthetic
  MISC_FEATURE (1)..(1): optionally absent
MGNRGSSTSSRPPLSS

SEQ ID NO: 107 - protein, 16 aa, Artificial Sequence
  Synthetic
  MISC_FEATURE (1)..(1): optionally absent
MGSYFVPPANYFFKDI

SEQ ID NO: 108 - protein, 16 aa, Artificial Sequence
  Synthetic
  MISC_FEATURE (1)..(1): optionally absent
MGAQLSTLSRVVLSPV

SEQ ID NO: 109 - protein, 16 aa, Artificial Sequence
  Synthetic
  MISC_FEATURE (1)..(1): optionally absent
MGNLKSVGQEPGPPCG

SEQ ID NO: 110 - protein, 16 aa, Artificial Sequence
  Synthetic
  MISC_FEATURE (1)..(1): optionally absent
MGSKRSVPSRHRSLTT

SEQ ID NO: 111 - protein, 16 aa, Artificial Sequence
  Synthetic
  MISC_FEATURE (1)..(1): optionally absent
MGNGESQLSSVPAQKL

SEQ ID NO: 112 - protein, 16 aa, Artificial Sequence
  Synthetic
  MISC_FEATURE (1)..(1): optionally absent
MGAHLVRRYLGDASVE

SEQ ID NO: 113 - protein, 16 aa, Artificial Sequence
  Synthetic
  MISC_FEATURE (1)..(1): optionally absent
MGGKLSKKKKGYNVND

SEQ ID NO: 114 - protein, 16 aa, Artificial Sequence
  Synthetic
  MISC_FEATURE (1)..(1): optionally absent
MGSCCSCPDKDTVPDN

SEQ ID NO: 115 - protein, 16 aa, Artificial Sequence
  Synthetic
  MISC_FEATURE (1)..(1): optionally absent
MGSSEVSIIPGLQKEE

SEQ ID NO: 116 - protein, 16 aa, Artificial Sequence
  Synthetic
  MISC_FEATURE (1)..(1): optionally absent
MLCCMRRTKQVEKNDE

SEQ ID NO: 117 - protein, 15 aa, Artificial Sequence
  Synthetic
  MISC_FEATURE (1)..(1): optionally absent
MGCLGNSKTEDQRNE

SEQ ID NO: 118 - protein, 18 aa, Artificial Sequence
  Synthetic
  MISC_FEATURE (1)..(1): optionally absent
MTLESIMACCLSEEAKEA

SEQ ID NO: 119 - protein, 18 aa, Artificial Sequence
  Synthetic
  MISC_FEATURE (1)..(1): optionally absent
MSGVVRTLSRCLLPAEAG

SEQ ID NO: 120 - protein, 19 aa, Artificial Sequence
  Synthetic
  MISC_FEATURE (1)..(1): optionally absent
MADFLPSRSVCFPGCVLTN

SEQ ID NO: 121 - protein, 21 aa, Artificial Sequence
  Synthetic
  MISC_FEATURE (1)..(1): optionally absent
MARSLRWRCCPWCLTEDEKAA

SEQ ID NO: 122 - protein, 25 aa, Artificial Sequence
  Synthetic
  MISC_FEATURE (1)..(1): optionally absent
MLCCMRRTKQVEKNDDDQKIEQDGI

SEQ ID NO: 123 - protein, 14 aa, Artificial Sequence
  Synthetic
  MISC_FEATURE (1)..(1): optionally absent
MQCCGLVHRRRVRV

SEQ ID NO: 124 - protein, 20 aa, Artificial Sequence
  Synthetic
  MISC_FEATURE (1)..(1): optionally absent
MDCLCIVTTKKYRYQDEDTP

SEQ ID NO: 125 - protein, 20 aa, Artificial Sequence
  Synthetic
  MISC_FEATURE (1)..(1): optionally absent
MCKGLAGLPASCLRSAKDMK

SEQ ID NO: 126 - protein, 16 aa, Artificial Sequence
  Synthetic
  MISC_FEATURE (1)..(1): optionally absent
MGCIKSKEDKGPAMKY

SEQ ID NO: 127 - protein, 16 aa, Artificial Sequence
  Synthetic
  MISC_FEATURE (1)..(1): optionally absent
MGCVQCKDKEATKLTE

SEQ ID NO: 128 - protein, 16 aa, Artificial Sequence
  Synthetic
  MISC_FEATURE (1)..(1): optionally absent
MGCIKSKRKDNLNDDE

SEQ ID NO: 129 - protein, 16 aa, Artificial Sequence
  Synthetic
  MISC_FEATURE (1)..(1): optionally absent
MGCVCSSNPEDDWMEN

SEQ ID NO: 130 - protein, 16 aa, Artificial Sequence
  Synthetic
  MISC_FEATURE (1)..(1): optionally absent
MGCMKSKFLQVGGNTG

SEQ ID NO: 131 - protein, 16 aa, Artificial Sequence
  Synthetic
  MISC_FEATURE (1)..(1): optionally absent
MGCVFCKKLEPVATAK

SEQ ID NO: 132 - protein, 16 aa, Artificial Sequence
  Synthetic
  MISC_FEATURE (1)..(1): optionally absent
MGCVHCKEKISGKGQG

SEQ ID NO: 133 - protein, 16 aa, Artificial Sequence
  Synthetic
  MISC_FEATURE (1)..(1): optionally absent
MGCTLSAEDKAAVERS

SEQ ID NO: 134 - protein, 16 aa, Artificial Sequence
  Synthetic
  MISC_FEATURE (1)..(1): optionally absent
MGCTLSAEERAALERS

SEQ ID NO: 135 - protein, 16 aa, Artificial Sequence
  Synthetic
  MISC_FEATURE (1)..(1): optionally absent
MGCRQSSEEKEAARRS

SEQ ID NO: 136 - protein, 15 aa, Artificial Sequence
  Synthetic
  MISC_FEATURE (1)..(1): optionally absent
MGQLCCFPFSRDEGK

SEQ ID NO: 137 - protein, 28 aa, Artificial Sequence
  Synthetic
  MISC_FEATURE (1)..(1): optionally absent
MGNLKSVGQEPGPPCGLGLGLGLGLCGK

SEQ ID NO: 138 - protein, 13 aa, Artificial Sequence
  Synthetic
SGPGCMSCKCVLS

SEQ ID NO: 139 - protein, 13 aa, Artificial Sequence
  Synthetic
GTQGCMGLPCVVM

SEQ ID NO: 140 - protein, 13 aa, Artificial Sequence
  Synthetic
TPGCVKIKKCVIM

SEQ ID NO: 141 - protein, 13 aa, Artificial Sequence
  Synthetic
DMKKHRCKCCSIM

SEQ ID NO: 142 - protein, 17 aa, Artificial Sequence
  Synthetic
SKDGKKKKKSKTKCVIM

SEQ ID NO: 143 - protein, 14 aa, Artificial Sequence
  Synthetic
KKKKKKSKTKCVIM

SEQ ID NO: 144 - protein, 8 aa, Artificial Sequence
  Synthetic
SKTKCVIM

SEQ ID NO: 145 - protein, 130 aa, Artificial Sequence
  Synthetic
HGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQK

SEQ ID NO: 146 - protein, 140 aa, Artificial Sequence
  Synthetic
  MISC_FEATURE (1)..(1): optionally absent
MDSGRDFLTLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQK

SEQ ID NO: 147 - protein, 140 aa, Artificial Sequence
  Synthetic
  MISC_FEATURE (1)..(1): optionally absent
MDSGRDFLTLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADVQHWVQGLRKIIDRSGSMDQRQK

SEQ ID NO: 148 - protein, 140 aa, Artificial Sequence
  Synthetic
  MISC_FEATURE (1)..(1): optionally absent
MDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQK

SEQ ID NO: 149 - protein, 130 aa, Artificial Sequence
  Synthetic
HGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQK

SEQ ID NO: 150 - protein, 178 aa, Artificial Sequence
  Synthetic
  MISC_FEATURE (1)..(1): optionally absent
MSGGKYVDSEGHLYTVPIREQGNIYKPNNKAMAEEMNEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTFCDPLFEAIGKIFSNIRINTQKEI

SEQ ID NO: 151 - protein, 178 aa, Artificial Sequence
  Synthetic
  MISC_FEATURE (1)..(1): optionally absent
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 152 - protein, 4 aa, Artificial Sequence
  Synthetic
  MISC_FEATURE (2)..(2): Xaa is T or S
PXAP

SEQ ID NO: 153 - protein, 9 aa, Artificial Sequence
  Synthetic
  MISC_FEATURE (1)..(1): Xaa is a hydrophobic residue
  MISC_FEATURE (3)..(4): X is any amino acid or absent
  MISC_FEATURE (5)..(5): or a hydrophobic residue
  MISC_FEATURE (6)..(8): X is any amino acid or absent
  MISC_FEATURE (9)..(9): Xaa is L or I
XYXXPXXXX

SEQ ID NO: 154 - protein, 4 aa, Artificial Sequence
  Synthetic
  MISC_FEATURE (3)..(3): Xaa is any amino acid
PPXY

SEQ ID NO: 155 - protein, 7 aa, Artificial Sequence
  Synthetic
  MISC_FEATURE (2)..(2): Xaa is T or S
  MISC_FEATURE (6)..(6): Xaa is any amino acid
PXAPPXY

SEQ ID NO: 156 - protein, 8 aa, Artificial Sequence
  Synthetic
  MISC_FEATURE (2)..(2): Xaa is T or S
  MISC_FEATURE (7)..(7): Xaa is any amino acid
PXAPYPXL

SEQ ID NO: 157 - protein, 8 aa, Artificial Sequence
  Synthetic
  MISC_FEATURE (3)..(3): Xaa is any amino acid
  MISC_FEATURE (6)..(6): Xaa is T or S
PPXYPXAP

SEQ ID NO: 158 - protein, 8 aa, Artificial Sequence
  Synthetic
  MISC_FEATURE (3)..(3): Xaa is any amino acid
  MISC_FEATURE (7)..(7): Xaa is any amino acid
PPXYYPXL

SEQ ID NO: 159 - protein, 8 aa, Artificial Sequence
  Synthetic
  MISC_FEATURE (3)..(3): Xaa is any amino acid
  MISC_FEATURE (7)..(7): Xaa is any amino acid
YPXLPPXY

SEQ ID NO: 160 - protein, 8 aa, Artificial Sequence
  Synthetic
  MISC_FEATURE (3)..(3): Xaa is any amino acid
  MISC_FEATURE (7)..(7): Xaa is any amino acid
YPXLPPXY

SEQ ID NO: 161 - protein, 7 aa, Artificial Sequence
  Synthetic
PTAPPEE

SEQ ID NO: 162 - protein, 6 aa, Artificial Sequence
  Synthetic
YPLTSL

SEQ ID NO: 163 - protein, 7 aa, Artificial Sequence
  Synthetic
PTAPPEY

SEQ ID NO: 164 - protein, 4 aa, Artificial Sequence
  Synthetic
YPDL

SEQ ID NO: 165 - protein, 4 aa, Artificial Sequence
  Synthetic
FPIV

SEQ ID NO: 166 - protein, 7 aa, Artificial Sequence
  Synthetic
PTAPPEY

SEQ ID NO: 167 - protein, 4 aa, Artificial Sequence
  Synthetic
PTAP

SEQ ID NO: 168 - protein, 4 aa, Artificial Sequence
  Synthetic
PPEY

SEQ ID NO: 169 - protein, 6 aa, Artificial Sequence
  Synthetic
YPLTSL

SEQ ID NO: 170 - protein, 18 aa, Artificial Sequence
  Synthetic
AAGAYDPARKLLEQYAKK

SEQ ID NO: 171 - protein, 80 aa, Artificial Sequence
  Synthetic
PNCFNSSINNIHEMEIQLKDALEKNQQWLVYDQQREVYVKGLLAKIFELEKKTETAAHSLPQQTKKPESEGYLQEEKQKC

SEQ ID NO: 172 - protein, 52 aa, Artificial Sequence
  Synthetic
LQSRPEPTAPPEESFRSGVETTTPPQKQEPIDKELYPLTSLRSLFGNDPSSQ

SEQ ID NO: 173 - protein, 20 aa, Artificial Sequence
  Synthetic
RRVILPTAPPEYMEAIYPVR

SEQ ID NO: 174 - protein, 51 aa, Artificial Sequence
  Synthetic
PIQQKSQHNKSVVQETPQTQNLYPDLSEIKKEYNVKEKDQVEDLNLDSLWE

SEQ ID NO: 175 - protein, 20 aa, Artificial Sequence
  Synthetic
NPRQSIKAFPIVINSDGGEK

SEQ ID NO: 176 - protein, 10 aa, Artificial Sequence
  Synthetic
PTAPPEYGGS

SEQ ID NO: 177 - protein, 7 aa, Artificial Sequence
  Synthetic
PTAPGGS

SEQ ID NO: 178 - protein, 7 aa, Artificial Sequence
  Synthetic
PPEYGGS

SEQ ID NO: 179 - protein, 9 aa, Artificial Sequence
  Synthetic
YPLTSLGGS

SEQ ID NO: 180 - protein, 7 aa, Artificial Sequence
  Synthetic
YPDLGGS

SEQ ID NO: 181 - protein, 7 aa, Artificial Sequence
  Synthetic
FPIVGGS

SEQ ID NO: 182 - protein, 52 aa, Artificial Sequence
  Synthetic
LQSRPEAAAAPEESFRSGVETTTPPQKQEPIDKELYPLTSLRSLFGNDPSSQ

SEQ ID NO: 183 - protein, 4 aa, Artificial Sequence
  Synthetic
  MISC_FEATURE (11)..(13): optionally absent
PTAP

SEQ ID NO: 184 - protein, 52 aa, Artificial Sequence
  Synthetic
LQSRPEPTAPPEESFRSGVETTTPPQKQEPIDKELAALTSLRSLFGNDPSSQ

SEQ ID NO: 185 - protein, 19 aa, Artificial Sequence
  Synthetic
SREKPYKEVTEDLLHLNSL

SEQ ID NO: 186 - protein, 51 aa, Artificial Sequence
  Synthetic
QSRPEPTAPPEESFRSGVETTTPPQKQEPIDKELYPLTSLRSLFGNDPSSQ

SEQ ID NO: 187 - protein, 17 aa, Artificial Sequence
  Synthetic
DPQIPPPPYVEPTAPQV

SEQ ID NO: 188 - protein, 11 aa, Artificial Sequence
  Synthetic
LLTEDPPPYRD

SEQ ID NO: 189 - protein, 11 aa, Artificial Sequence
  Synthetic
TASAPPPPYVG

SEQ ID NO: 190 - protein, 15 aa, Artificial Sequence
  Synthetic
TPQTQNLYPDLSEIK

SEQ ID NO: 191 - protein, 17 aa, Artificial Sequence
  Synthetic
  MISC_FEATURE (1)..(1): optionally absent
MRRVILPTAPPEYMEAI

SEQ ID NO: 192 - protein, 16 aa, Artificial Sequence
  Synthetic
NTYMQYLNPPPYADHS

SEQ ID NO: 193 - protein, 21 aa, Artificial Sequence
  Synthetic
LGIAPPPYEEDTSMEYAPSAP

SEQ ID NO: 194 - protein, 16 aa, Artificial Sequence
  Synthetic
DDLWLPPPEYVPLKEL

SEQ ID NO: 195 - protein, 20 aa, Artificial Sequence
  Synthetic
AAPTAPPTGAADSIPPPYSP

SEQ ID NO: 196 - protein, 11 aa, Artificial Sequence
  Synthetic
TAPSSPPPYEE

SEQ ID NO: 197 - protein, 14 aa, Artificial Sequence
  Synthetic
QSIKAFPIVINSDG

SEQ ID NO: 198 - protein, 22 aa, Artificial Sequence
  Synthetic
DRRRRGSRPSGAERRRRRAAAA

SEQ ID NO: 199 - protein, 97 aa, Artificial Sequence
  Synthetic
AVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 200 - protein, 55 aa, Artificial Sequence
  Synthetic
  MISC_FEATURE (1)..(1): optionally absent
MQKGNFRNQRKTVKCFNCGKEGHIAKNCRAPRKKGCWKCGKEGHQMKDCTERQAN

SEQ ID NO: 201 - protein, 14 aa, Artificial Sequence
  Synthetic
RPRGTRGKGRRIRR

SEQ ID NO: 202 - protein, 96 aa, Artificial Sequence
  Synthetic
EQAPEDQGPQREPHNEWTLELLEELKREAVRHFPRPWLHGLGQHIYETYGDTWAGVEAIIRILQQLLFIHFRIGCQHSRIGIIQQRRARRNGASRS

SEQ ID NO: 203 - protein, 384 aa, Artificial Sequence
  Synthetic
  MISC_FEATURE (1)..(1): optionally absent
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHWGSEQAPEDQGPQREPHNEWTLELLEELKREAVRHFPRPWLHGLGQHIYETYGDTWAGVEAIIRILQQLLFIHFRIGCQHSRIGIIQQRRARRNGASRS

SEQ ID NO: 204 - RNA, 32 nt, Artificial Sequence
  Synthetic
ggucugggcgcacuucggugacgguacaggcc

SEQ ID NO: 205 - RNA, 21 nt, Artificial Sequence
  Synthetic
aauccauugcacuccggauuu

SEQ ID NO: 206 - RNA, 44 nt, Artificial Sequence
  Synthetic
ggcgacuggugaguacgccaaaaauuuugacuagcggaggcuag

SEQ ID NO: 207 - RNA, 28 nt, Artificial Sequence
  Synthetic
ggcucguguagcucauuagcuccgagcc

SEQ ID NO: 208 - RNA, 972 nt, Artificial Sequence
  Synthetic
ggucugggcgcacuucggugacgguacaggccuaggauuacugcucggugacuuauaaucauccuccccgccaccauggacuacaaagacgacgaugacaaagguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggucugggcgcacuucggugacgguacaggcc

SEQ ID NO: 209 - RNA, 950 nt, Artificial Sequence
  Synthetic
aauccauugcacuccggauuuuaggauuacugcucggugacuuauaaucauccuccccgccaccauggacuacaaagacgacgaugacaaagguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugaauccauugcacuccggauuu

SEQ ID NO: 210 - RNA, 996 nt, Artificial Sequence
  Synthetic
ggcgacuggugaguacgccaaaaauuuugacuagcggaggcuaguaggauuacugcucggugacuuauaaucauccuccccgccaccauggacuacaaagacgacgaugacaaagguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggcgacuggugaguacgccaaaaauuuugacuagcggaggcuag

SEQ ID NO: 211 - RNA, 964 nt, Artificial Sequence
  Synthetic
ggcucguguagcucauuagcuccgagccuaggauuacugcucggugacuuauaaucauccuccccgccaccauggacuacaaagacgacgaugacaaagguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggcucguguagcucauuagcuccgagcc

SEQ ID NO: 212 - RNA, 978 nt, Artificial Sequence
  Synthetic
ggucugggcgcacuucggugacgguacaggccuaggauuacugcucggugacuuauaaucauccuccccgccaccauggaacagaaacugauuagcgaagaagaucuggguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggucugggcgcacuucggugacgguacaggcc

SEQ ID NO: 213 - RNA, 956 nt, Artificial Sequence
  Synthetic
aauccauugcacuccggauuuuaggauuacugcucggugacuuauaaucauccuccccgccaccauggaacagaaacugauuagcgaagaagaucuggguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugaauccauugcacuccggauuu

SEQ ID NO: 214 - RNA, 1002 nt, Artificial Sequence
  Synthetic
ggcgacuggugaguacgccaaaaauuuugacuagcggaggcuaguaggauuacugcucggugacuuauaaucauccuccccgccaccauggaacagaaacugauuagcgaagaagaucuggguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggcgacuggugaguacgccaaaaauuuugacuagcggaggcuag

SEQ ID NO: 215 - RNA, 970 nt, Artificial Sequence
  Synthetic
ggcucguguagcucauuagcuccgagccuaggauuacugcucggugacuuauaaucauccuccccgccaccauggaacagaaacugauuagcgaagaagaucuggguucugacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacgagcacacauccuauuugggccuagcaaccaacaguaugggcucguguagcucauuagcuccgagcc

SEQ ID NO: 216 - RNA, 897 nt, Artificial Sequence
  Synthetic
ggucugggcgcacuucggugacgguacaggccuaggauuacugcucggugacuuauaaucauccuccccgccaccauggaacagaaacugauuagcgaagaagaucuggugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacaaguaacgagcacacauccuauuugggccuagcaaccaacaguaugggucugggcgcacuucggugacgguacaggcc

SEQ ID NO: 217 - RNA, 875 nt, Artificial Sequence
  Synthetic
aauccauugcacuccggauuuuaggauuacugcucggugacuuauaaucauccuccccgccaccauggaacagaaacugauuagcgaagaagaucuggugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacaaguaagcuccacacauccuauuugggccuagcaaccaacaguaugaauccauugcacuccggauuu

SEQ ID NO: 218 - RNA, 921 nt, Artificial Sequence
  Synthetic
ggcgacuggugaguacgccaaaaauuuugacuagcggaggcuaguaggauuacugcucggugacuuauaaucauccuccccgccaccauggaacagaaacugauuagcgaagaagaucuggugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacaaguaacagccacacauccuauuugggccuagcaaccaacaguaugggcgacuggugaguacgccaaaaauuuugacuagcggaggcuag

SEQ ID NO: 219 - RNA, 889 nt, Artificial Sequence
  Synthetic
ggcucguguagcucauuagcuccgagccuaggauuacugcucggugacuuauaaucauccuccccgccaccauggaacagaaacugauuagcgaagaagaucuggugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacaaguaagucgcacacauccuauuugggccuagcaaccaacaguaugggcucguguagcucauuagcuccgagcc

SEQ ID NO: 220 - protein, 274 aa, Artificial Sequence
  Synthetic
  MISC_FEATURE (1)..(1): optionally absent
  MISC_FEATURE (2)..(9): Myc tag optionally absent
MDYKDDDDKGSDPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 221 - protein, 276 aa, Artificial Sequence
  Synthetic
  MISC_FEATURE (1)..(1): optionally absent
  MISC_FEATURE (3)..(11): Myc tag optionally absent
MEQKLISEEDLGSDPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 222 - protein, 249 aa, Artificial Sequence
  Synthetic
  MISC_FEATURE (1)..(1): optionally absent
  MISC_FEATURE (3)..(11): Myc tag optionally absent
MEQKLISEEDLVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 223 - protein, 4 aa, Artificial Sequence
  Synthetic
GSGS

SEQ ID NO: 224 - protein, 10 aa, Artificial Sequence
  Synthetic
GSDGSGRSGS

SEQ ID NO: 225 - protein, 12 aa, Artificial Sequence
  Synthetic
GSKSGSGSDSGS

SEQ ID NO: 226 - protein, 22 aa, Artificial Sequence
  Synthetic
GSGSGDGGRGSRGGDGSGGSSG

SEQ ID NO: 227 - protein, 282 aa, Artificial Sequence
  Synthetic
  MISC_FEATURE (1)..(1): optionally absent
  MISC_FEATURE (222)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 228 - protein, 380 aa, Artificial Sequence
  Synthetic
  MISC_FEATURE (1)..(22): optionally absent
  MISC_FEATURE (370)..(378): FLAG tag- optionally absent
MVRRVILPTAPPEYMEAIYPVRGSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEGSDGSGRSGSHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKDYKDDDDKGS

SEQ ID NO: 229 - protein, 282 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQ

SEQ ID NO: 230 - protein, 282 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 231 - protein, 282 aa, Artificial Sequence
  Synthetic
  MISC_FEATURE (1)..(1): optionally absent
  MISC_FEATURE (223)..(231): Myc tag-optionally absent
MGAQFSGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 232 - protein, 289 aa, Artificial Sequence
  Synthetic
  MISC_FEATURE (1)..(1): optionally absent
  MISC_FEATURE (230)..(238): Myc tag-optionally absent
MGCIKSKRKDNLNGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 233 - protein, 289 aa, Artificial Sequence
  Synthetic
  MISC_FEATURE (1)..(1): optionally absent
  MISC_FEATURE (230)..(238): Myc tag-optionally absent
MGCTLSAEERAALGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 234 - protein, 289 aa, Artificial Sequence
  Synthetic
  MISC_FEATURE (1)..(1): optionally absent
  MISC_FEATURE (230)..(238): Myc tag-optionally absent
MLCCMRRTKQVEKGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 235 - protein, 278 aa, Artificial Sequence
  Synthetic
  MISC_FEATURE (1)..(1): optionally absent
  MISC_FEATURE (270)..(278): Myc tag-optionally absent
MGCIKSKRKDNLNLQSRPEPTAPPEESFRSGVETTTPPQKQEPIDKELYPLTSLRSLFGNDPSSQKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDL

SEQ ID NO: 236 - protein, 399 aa, Artificial Sequence
  Synthetic
  MISC_FEATURE (1)..(1): optionally absent
  MISC_FEATURE (340)..(348): Myc tag-optionally absent
MHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKGSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 237 - protein, 368 aa, Artificial Sequence
  Synthetic
  MISC_FEATURE (1)..(1): optionally absent
  MISC_FEATURE (230)..(238): Myc tag-optionally absent
MRRVILPTAPPEYMEAIYPVRGSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQK

SEQ ID NO: 238 - protein, 400 aa, Artificial Sequence
  Synthetic
  MISC_FEATURE (1)..(1): optionally absent
  MISC_FEATURE (392)..(400): Myc tag-optionally absent
MLQSRPEPTAPPEESFRSGVETTTPPQKQEPIDKELYPLTSLRSLFGNDPSSQHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKGSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDL

SEQ ID NO: 239 - protein, 396 aa, Artificial Sequence
  Synthetic
  MISC_FEATURE (1)..(1): optionally absent
  MISC_FEATURE (388)..(396): Myc tag-optionally absent
MHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKLQSRPEPTAPPEESFRSGVETTTPPQKQEPIDKELYPLTSLRSLFGNDPSSQKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDL

SEQ ID NO: 240 - protein, 395 aa, Artificial Sequence
  Synthetic
  MISC_FEATURE (1)..(1): optionally absent
  MISC_FEATURE (206)..(214): Myc tag-optionally absent
MKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQK

SEQ ID NO: 241 - protein, 251 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLRRVILPTAPPEYMEAIYPVR

SEQ ID NO: 242 - protein, 282 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLPIQQKSQHNKSVVQETPQTQNLYPDLSEIKKEYNVKEKDQVEDLNLDSLWE

SEQ ID NO: 243 - protein, 251 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLNPRQSIKAFPIVINSDGGEK

SEQ ID NO: 244 - protein, 305 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGLQSRPEPTAPPEESFRSGVETTTPPQKQEPIDKELYPLTSLRSLFGNDPSSQ

SEQ ID NO: 245 - protein, 304 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGPIQQKSQHNKSVVQETPQTQNLYPDLSEIKKEYNVKEKDQVEDLNLDSLWE

SEQ ID NO: 246 - protein, 273 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGNPRQSIKAFPIVINSDGGEK

SEQ ID NO: 247 - protein, 263 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGPTAPPEYGGS

SEQ ID NO: 248 - protein, 260 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGPTAPGGS

SEQ ID NO: 249 - protein, 262 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGYPLTSLGGS

SEQ ID NO: 250 - protein, 260 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGYPDLGGS

SEQ ID NO: 251 - protein, 260 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGSGSGDGGRGSRGGDGSGGSSGFPIVGGS

SEQ ID NO: 252 - protein, 375 aa, Artificial Sequence
  Synthetic
  MISC_FEATURE (1)..(1): optionally absent
  MISC_FEATURE (237)..(245): Myc tag-optionally absent
MLQSRPEPTAPPEESFRSGVETTTPPQKQEPIDKELYPLTSLRSLFGNDPSSQSQAIGILELTSIAAGMELGDAMLKSANVDLLVSKTISPGKFLLMLGGDIGAIQQAIETGTSQAGELLVDSLVLANIHPSVLPAISGLNSVDKRQAVGIVETWSVAACISAADRAVKGSNVTLVRVHMAFGIGGKCYMVVAGDVSDVALAVTVASSSAGAYGLLVYASLIPRPHEAMWRQMVEGQKLISEEDLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQK

SEQ ID NO: 253 - protein, 634 aa, Artificial Sequence
  Synthetic
  MISC_FEATURE (1)..(1): optionally absent
  MISC_FEATURE (575)..(583): Myc tag-optionally absent
MHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKKGEELFTGVVPILVELDGDVNGHKFSVRGEGEGDATNGKLTLKFICTTGKLPVPWPTLVTTLTYGVQCFARYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYGSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 254 - protein, 311 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGGSKGSDRRRRGSRPSGAERRRRRAAAA

SEQ ID NO: 255 - protein, 329 aa, Artificial Sequence
  Synthetic
  MISC_FEATURE (1)..(1): optionally absent
  MISC_FEATURE (223)..(231): myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGSFFREDLAFLQGKARELGGSKGSDRRRRGSRPSGAERRRRRAAAA

SEQ ID NO: 256 - protein, 310 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGGSKGSDRRRRGSRPSGAERRRRRAAAA

SEQ ID NO: 257 - protein, 328 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGSFFREDLAFLQGKARELGGSKGSDRRRRGSRPSGAERRRRRAAAA

SEQ ID NO: 258 - protein, 386 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGGSKGSAVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 259 - protein, 404 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGSFFREDLAFLQGKARELGGSKGSAVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 260 - protein, 385 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGGSKGSAVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 261 - protein, 403 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGSFFREDLAFLQGKARELGGSKGSAVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 262 - protein, 344 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGGSKGSMQKGNFRNQRKTVKCFNCGKEGHIAKNCRAPRKKGCWKCGKEGHQMKDCTERQAN

SEQ ID NO: 263 - protein, 362 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGSFFREDLAFLQGKARELGGSKGSMQKGNFRNQRKTVKCFNCGKEGHIAKNCRAPRKKGCWKCGKEGHQMKDCTERQAN

SEQ ID NO: 264 - protein, 343 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGGSKGSMQKGNFRNQRKTVKCFNCGKEGHIAKNCRAPRKKGCWKCGKEGHQMKDCTERQAN

SEQ ID NO: 265 - protein, 361 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGSFFREDLAFLQGKARELGGSKGSMQKGNFRNQRKTVKCFNCGKEGHIAKNCRAPRKKGCWKCGKEGHQMKDCTERQAN

SEQ ID NO: 266 - protein, 303 aa, Artificial Sequence
  Synthetic
  MISC_FEATURE (1)..(1): optionally absent
  MISC_FEATURE (223)..(231): Myc Tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGGSKGSRPRGTRGKGRRIRR

SEQ ID NO: 267 - protein, 321 aa, Artificial Sequence
  Synthetic
  MISC_FEATURE (1)..(1): optionally absent
  MISC_FEATURE (223)..(231): Myc tag-optionally absent
MGARASGSKSGSGSDSGSKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLLQSRPEPTAPPEESFRSGVETTTPPQKQEPIDKELYPLTSLRSLFGNDPSSQGSFFREDLAFLQGKARELGGSKGSRPRGTRGKGRRIRR

SEQ ID NO: 268 - protein, 302 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGGSKGSRPRGTRGKGRRIRR

SEQ ID NO: 269 - protein, 320 aa, Artificial Sequence
  Synthetic
  MISC_FEATURE (1)..(1): optionally absent
  MISC_FEATURE (223)..(231): Myc tag-optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLKNVCKWFKAGVLAVGVGKALVKGTPVEVAKKAKAFVKKIRGCTEQKLISEEDLQSRPEPTAPPEESFRSGVETTTPPQKQEPIDKELYPLTSLRSLFGNDPSSQGSFFREDLAFLQGKARELGGSKGSRPRGTRGKGRRIRR

SEQ ID NO: 270 - protein, 207 aa, Artificial Sequence
  Synthetic
MEGMDPLAVLAESRLLPLLTVRGGEDLAGLATVLELMGVGALEITLRTEKGLEALKALRKSGLLLGAGTVRSPKEAEAALEAGAAFLVSPGLLEEVAALAQARGVPYLPGVLTPTEVERALALGLSALKFFPAEPFQGVRVLRAYAEVFPEVRFLPTGGIKEEHLPHYAALPNLLAVGGSWLLQGDLAAVMKKVKAAKALLSPQAPG

SEQ ID NO: 271 - protein, 156 aa, Artificial Sequence
  Synthetic
MTKKVGIVDTTFARVDMAEAAIRTLKALSPNIKIIRKTVPGIKDLPVACKKLLEEEGCDIVMALGMPGKAEKDKVCAHEASLGLMLAQLMTNKHIIEVFVHEDEAKDDDELDILALVRAIEHAANVYYLLFKPEYLTRMAGKGLRQGREDAGPARE

SEQ ID NO: 272 - protein, 156 aa, Artificial Sequence
  Synthetic
MTKKVGIVDTTFARVDMASAAILTLKMESPNIKIIRKTVPGIKDLPVACKKLLEEEGCDIVMALGMPGKAEKDKVCAHEASLGLMLAQLMTNKHIIEVFVHEDEAKDDAELKILAARRAIEHALNVYYLLFKPEYLTRMAGKGLRQGFEDAGPARE

SEQ ID NO: 273 - protein, 209 aa, Artificial Sequence
  Synthetic
MSTINNQLKALKVIPVIAIDNAEDIIPLGKVLAENGLPAAEITFRSSAAVKAIMLLRSAQPEMLIGAGTILNGVQALAAKEAGATFVVSPGFNPNTVRACQIIGIDIVPGVNNPSTVEAALEMGLTTLKFFPAEASGGISMVKSLVGPYGDIRLMPTGGITPSNIDNYLAIPQVLACGGTWMVDKKLVTNGEWDEIARLTREIVEQVNP

SEQ ID NO: 274 - protein, 114 aa, Artificial Sequence
  Synthetic
MPIFTLNTNIKATDVPSDFLSLTSRLVGLILSKPGSYVAVHINTDQQLSFGGSTNPAAFGTLMSIGGIEPSKNRDHSAVLFDHLNAMLGIPKNRMYIHFVNLNGDDVGWNGTTF

SEQ ID NO: 275 - protein, 157 aa, Artificial Sequence
  Synthetic
MNQHSHKDYETVRIAVVRARWHADIVDACVEAFEIAMAAIGGDRFAVDVFDVPGAYEIPLHARTLAETGRYGAVLGTAFVVNGGIYRHEFVASAVIDGMMNVQLSTGVPVLSAVLTPHRYRDSAEHHRFFAAHFAVKGVEAARACIEILAAREKIAA

SEQ ID NO: 276 - protein, 205 aa, Artificial Sequence
  Synthetic
MKMEELFKKHKIVAVLRANSVEEAIEKAVAVFAGGVHLIEITFTVPDADTVIKALSVLKEKGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPDEVREKAKAFVEKIRGCTE

SEQ ID NO: 277 - protein, 157 aa, Artificial Sequence
  Synthetic
MNQHSHKDYETVRIAVVRARWHAEIVDACVSAFEAAMADIGGDRFAVDVFDVPGAYEIPLHARTLAETGRYGAVLGTAFVVNGGIYRHEFVASAVIDGMMNVQLSTGVPVLSAVLTPHRYRDSDAHTLLFLALFAVKGMEAARACVEILAAREKIAA

SEQ ID NO: 278 - protein, 177 aa, Artificial Sequence
  Synthetic
MFTKSGDDGNTNVINKRVGKDSPLVNFLGDLDELNSFIGFAISKIPWEDMKKDLERVQVELFEIGEDLSTQSSKKKIDESYVLWLLAATAIYRIESGPVKLFVIPGGSEEASVLHVTRSVARRVERNAVKYTKELPEINRMIIVYLNRLSSLLFAMALVANKRRNQSEKIYEIGKSW

SEQ ID NO: 279 - protein, 157 aa, Artificial Sequence
  Synthetic
MNQHSHKDYETVRIAVVRARWHADIVDQCVRAFEEAMADAGGDRFAVDVFDVPGAYEIPLHARTLAETGRYGAVLGTAFVVNGGIYRHEFVASAVIDGMMNVQLSTGVPVLSAVLTPHRYRSSREHHEFFREHFMVKGVEAAAACITILAAREKIAA

SEQ ID NO: 280 - protein, 6 aa, Artificial Sequence
  Synthetic
  MISC_FEATURE (1)..(1): optionally absent
MGARAS

SEQ ID NO: 281 - protein, 6 aa, Artificial Sequence
  Synthetic
  MISC_FEATURE (1)..(1): optionally absent
MGAQFS

SEQ ID NO: 282 - protein, 6 aa, Artificial Sequence
  Synthetic
  MISC_FEATURE (1)..(1): optionally absent
MGSSKS

SEQ ID NO: 283 - protein, 6 aa, Artificial Sequence
  Synthetic
  MISC_FEATURE (1)..(1): optionally absent
MGKQNS

SEQ ID NO: 284 - protein, 13 aa, Artificial Sequence
  Synthetic
  MISC_FEATURE (1)..(1): optionally absent
MGCIKSKRKDNLN

SEQ ID NO: 285 - protein, 13 aa, Artificial Sequence
  Synthetic
  MISC_FEATURE (1)..(1): optionally absent
MGCTLSAEERAAL

SEQ ID NO: 286 - protein, 13 aa, Artificial Sequence
  Synthetic
  MISC_FEATURE (1)..(1): optionally absent
MLCCMRRTKQVEK

SEQ ID NO: 287 - protein, 13 aa, Artificial Sequence
  Synthetic
  MISC_FEATURE (1)..(1): optionally absent
MDCLCIVTTKKYR

SEQ ID NO: 288 - protein, 13 aa, Artificial Sequence
  Synthetic
KKKKKSKTKCVIM

SEQ ID NO: 289 - protein, 13 aa, Artificial Sequence
  Synthetic
DMKKHRCKCCSIM

SEQ ID NO: 290 - protein, 13 aa, Artificial Sequence
  Synthetic
AQRQKKRRLCLLL

SEQ ID NO: 291 - protein, 13 aa, Artificial Sequence
  Synthetic
AQEFIHQFLCNPL

SEQ ID NO: 292 - protein, 130 aa, Artificial Sequence; identical to SEQ ID NO: 145
  Synthetic

SEQ ID NO: 293 - protein, 52 aa, Artificial Sequence
  Synthetic
PHRFKVHNYMSPTFCDHCGSLLWGLVKQGLKCEDCGMNVHHKCREKVANLCG

SEQ ID NO: 294 - protein, 126 aa, Artificial Sequence
  Synthetic
GAVKLSVSYRNGTLFIMVMHIKDLVTEDGADPNPYVKTYLLPDTHKTSKRKTKISRKTRNPTFNEMLVYSGYSKETLRQRELQLSVLSAESLRENFFLGGITLPLKDFNLSKETVKWYQLTAATYL

SEQ ID NO: 295 - protein, 148 aa, Artificial Sequence
  Synthetic
AVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRR

SEQ ID NO: 296 - protein, 13 aa, Artificial Sequence
  Synthetic
  MISC_FEATURE (1)..(1): optionally absent
MGCIKSKGKDSLS

SEQ ID NO: 297 - protein, 10 aa, Artificial Sequence
  Synthetic
  MISC_FEATURE (1)..(1): optionally absent
MGCINSKRKD

SEQ ID NO: 298 - protein, 16 aa, Artificial Sequence
  Synthetic
  MISC_FEATURE (1)..(1): optionally absent
MGSSKSKPKDPSQRRR

SEQ ID NO: 299 - protein, 16 aa, Artificial Sequence
  Synthetic
  MISC_FEATURE (1)..(1): optionally absent
MGCIKSKEDKGPAMKY

SEQ ID NO: 300 - protein, 6 aa, Artificial Sequence
  Synthetic
  MISC_FEATURE (1)..(1): optionally absent
  MISC_FEATURE (3)..(5): Xaa is any amino acid
  MISC_FEATURE (6)..(6): Xaa is T or S
MGXXXX

SEQ ID NO: 301 - protein, 4 aa, Artificial Sequence
  Synthetic
  MISC_FEATURE (3)..(3): Xaa is any amino acid
YPXL

SEQ ID NO: 302 - protein, 6 aa, Artificial Sequence
  Synthetic
YPLTSL

SEQ ID NO: 303 - protein, 4 aa, Artificial Sequence
  Synthetic
PTAP

SEQ ID NO: 304 - protein, 205 aa, Artificial Sequence
  Synthetic
  MISC_FEATURE (1)..(1): optionally absent
MKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTE

SEQ ID NO: 305 - protein, 18 aa, Artificial Sequence
  Synthetic
RKSPTPSAPVPLTEPAAQ

SEQ ID NO: 306 - protein, 62 aa, Artificial Sequence
  Synthetic
  MISC_FEATURE (1)..(1): optionally absent
MSLYPSLEDLKVDKVIQAQTAFSANPANPAILSEASAPIPHDGNLYPRLYPELSQYMGLSLN

SEQ ID NO: 307 - protein, 511 aa, Artificial Sequence
  Synthetic
  MISC_FEATURE (1)..(1): optionally absent
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 308 - protein, 665 aa, Artificial Sequence
  Synthetic
  MISC_FEATURE (1)..(1): optionally absent
MARSTLSKPLKNKVNPRGPLIPLILLMLRGVSTASPGSSPHQVYNITWEVTNGDRETVWATSGNHPLWTWWPDLTPDLCMLAHHGPSYWGLEYQSPFSSPPGPPCCSGGSSPGCSRDCEEPLTSLTPRCNTAWNRLKLDQTTHKSNEGFYVCPGPHRPRESKSCGGPDSFYCAYWGCETTGRAYWKPSSSWDFITVNNNLTSDQAVQVCKDNKWCNPLVIRFTDAGRRVTSWTTGHYWGLRLYVSGQDPGLTFGIRLRYQNLGPRVPIGPNPVLADQQPLSKPKPVKSPSVTKPPSGTPLSPTQLPPAGTENRLLNLVDGAYQALNLTSPDKTQECWLCLVAGPPYYEGVAVLGTYSNHTSAPANCSVASQHKLTLSEVTGQGLCIGAVPKTHQALCNTTQTSSRGSYYLVAPTGTMWACSTGLTPCISTTILNLTTDYCVLVELWPRVTYHSPSYVYGLFERSNRHKREPVSLTLALLLGGLTMGGIAAGIGTGTTALMATQQFQQLQAAVQDDLREVEKSISNLEKSLTSLSEVVLQNRRGLDLLFLKEGGLCAALKEECCFYADHTGLVRDSMAKLRERLNQRQKLFESTQGWFEGLFNRSPWFTTLISTIMGPLIVLLMILLFGPCILNRLVQFVKDRISVVQALVLTQQYHQLKPIEYEP

SEQ ID NO: 309 - protein, 654 aa, Artificial Sequence
  Synthetic
  MISC_FEATURE (1)..(1): optionally absent
MARSTLSKPPQDKINPWKPLIVMGVLLGVGMAESPHQVFNVTWRVTNLMTGRTANATSLLGTVQDAFPKLYFDLCDLVGEEWDPSDQEPYVGYGCKYPAGRQRTRTFDFYVCPGHTVKSGCGGPGEGYCGKWGCETTGQAYWKPTSSWDLISLKRGNTPWDTGCSKVACGPCYDLSKVSNSFQGATRGGRCNPLVLEFTDAGKKANWDGPKSWGLRLYRTGTDPITMFSLTRQVLNVGPRVPIGPNPVLPDQRLPSSPIEIVPAPQPPSPLNTSYPPSTTSTPSTSPTSPSVPQPPPGTGDRLLALVKGAYQALNLTNPDKTQECWLCLVSGPPYYEGVAVVGTYTNHSTAPANCTATSQHKLTLSEVTGQGLCMGAVPKTHQALCNTTQSAGSGSYYLAAPAGTMWACSTGLTPCLSTTVLNLTTDYCVLVELWPRVIYHSPDYMYGQLEQRTKYKREPVSLTLALLLGGLTMGGIAAGIGTGTTALIKTQQFEQLHAAIQTDLNEVEKSITNLEKSLTSLSEVVLQNRRGLDLLFLKEGGLCAALKEECCFYADHTGLVRDSMAKLRERLNQRQKLFETGQGWFEGLFNRSPWFTTLISTIMGPLIVLLLILLFGPCILNRLVQFVKDRISVVQALVLTQQYHQLKPIEYEP

SEQ ID NO: 310 - protein, 981 aa, Artificial Sequence
  Synthetic
SAAPLVTAMCLLGNVSFPCDRPPTCYTREPSRALDILEENVNHEAYDTLLNAILRCGSSGRSKRSVIDDFTLTSPYLGTCSYCHHTVPCFSPVKIEQVWDEADDNTIRIQTSAQFGYDQSGAASANKYRYMSLKQDHTVKEGTMDDIKISTSGPCRRLSYKGYFLLAKCPPGDSVTVSIVSSNSATSCTLARKIKPKFVGREKYDLPPVHGKKIPCTVYDRLKETTAGYITMHRPRPHAYTSYLEESSGKVYAKPPSGKNITYECKCGDYKTGTVSTRTEITGCTAIKQCVAYKSDQTKWVFNSPDLIRHDDHTAQGKLHLPFKLIPSTCMVPVAHAPNVIHGFKHISLQLDTDHLTLLTTRRLGANPEPTTEWIVGKTVRNFTVDRDGLEYIWGNHEPVRVYAQESAPGDPHGWPHEIVQHYYHRHPVYTILAVASATVAMMIGVTVAVLCACKARRECLTPYALAPNAVIPTSLALLCCVRSANAETFTETMSYLWSNSQPFFWVQLCIPLAAFIVLMRCCSCCLPFLVVAGAYLAKVDAYEHATTVPNVPQIPYKALVERAGYAPLNLEITVMSSEVLPSTNQEYITCKFTTVVPSPKIKCCGSLECQPAAHADYTCKVFGGVYPFMWGGAQCFCDSENSQMSEAYVELSADCASDHAQAIKVHTAAMKVGLRIVYGNTTSFLDVYVNGVTPGTSKDLKVIAGPISASFTPFDHKVVIHRGLVYNYDFPEYGAMKPGAFGDIQATSLTSKDLIASTDIRLLKPSAKNVHVPYTQASSGFEMWKNNSGRPLQETAPFGCKIAVNPLRAVDCSYGNIPISIDIPNAAFIRTSDAPLVSTVKCEVSECTYSADFGGMATLQYVSDREGQCPVHSHSSTATLQESTVHVLEKGAVTVHFSTASPQANFIVSLCGKKTTCNAECKPPADHIVSTPHKNDQEFQAAISKTSWSWLFALFGGASSLLIIGLMIFACSMMLTSTRR

SEQ ID NO: 311 - protein, 676 aa, Artificial Sequence
  Synthetic
  MISC_FEATURE (1)..(1): optionally absent
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 312 - protein, 853 aa, Artificial Sequence
  Synthetic
  MISC_FEATURE (1)..(1): optionally absent
MRVKEKYQHLWRWGWKWGIMLLGILMICSATENLWVTVYYGVPVWKEATTTLFCASDAKAYDTEVHNVCATHACVPTDPNPQEVILVNVTENFDMWKNDMVEQMHEDIISLWDQSLKPCVKLTPLCVNLKCTDLKNDTNTNSSNGRMIMEKGEIKNCSFNISTSIRNKVQKEYAFFYKLDIRPIDNTTYRLISCNTSVITQACPKVSFEPIPIHYCAPAGFAILKCNDKTFNGTGPCTNVSTVQCTHGIRPVVSTQLLLNGSLAEEEGVIRSANFTDNAKTIIVQLNTSVEINCTRPNNNTRKSIRIQRGPGRAFVTIGKIGNMRQAHCNISRAKWMSTLKQIASKLREQFGNNKTVIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGKNTNESEVFRPGGGDMRDNWRSELYKYKVVKIETLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQFWNNMTWMEWDREINNYTSLIHSLIDESQNQQEKNEQELLELDKWASLWNWFNITNWLWYIKIFIMIVGGLVGLRIVFAVLSIVNRVRQGYSPLSFQTHLPNRGGPDRPEGIEEEGGERDRDRSVRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERIL

SEQ ID NO: 313 - protein, 574 aa, Artificial Sequence
  Synthetic
  MISC_FEATURE (1)..(1): optionally absent
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 314 - protein, 1255 aa, Artificial Sequence
  Synthetic
  MISC_FEATURE (1)..(1): optionally absent
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 315 - protein, 566 aa, Artificial Sequence
  Synthetic
  MISC_FEATURE (1)..(1): optionally absent
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 316 - protein, 4 aa, Artificial Sequence
  Synthetic
AAAA

SEQ ID NO: 317 - protein, 263 aa, Artificial Sequence
  Synthetic
  MISC_FEATURE (1)..(1): optionally absent
  MISC_FEATURE (204)..(212): optionally absent
MEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSLFGNDPSSQ

SEQ ID NO: 318 - protein, 282 aa, Artificial Sequence
  Synthetic
  MISC_FEATURE (1)..(1): optionally absent
  MISC_FEATURE (223)..(231): optionally absent
MGARASGSKSGSGSDSGSKMEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLQSRPEPTAPPEESFRSGVETTTPPQKQEPIDKELYPLTSLRSAAGNDPSSQ

SEQ ID NO: 319 - DNA, 20 bp, Artificial Sequence
  Synthetic
catactgttggttgctaggc

SEQ ID NO: 320 - DNA, 24 bp, Artificial Sequence
  Synthetic
gctgtgacgataacgttgtagatg

SEQ ID NO: 321 - DNA, 20 bp, Artificial Sequence
  Synthetic
ggacgatgggcatgaaactg

SEQ ID NO: 322 - DNA, 20 bp, Artificial Sequence
  Synthetic
taggattactgctcggtgac

SEQ ID NO: 323 - protein, 20 aa, Artificial Sequence
  Synthetic
CCAAATAGGATGTGTGCGAC

SEQ ID NO: 324 - DNA, 26 bp, Artificial Sequence
  Synthetic
ccacaaagacattggaacactatacc

SEQ ID NO: 325 - DNA, 24 bp, Artificial Sequence
  Synthetic
gctgtgacgataacgttgtagatg

SEQ ID NO: 326 - DNA, 26 bp, Artificial Sequence
  Synthetic
ccttatctgcttcctagtcctgtatg

SEQ ID NO: 327 - DNA, 20 bp, Artificial Sequence
  Synthetic
ggacgatgggcatgaaactg

SEQ ID NO: 328 - protein, 532 aa, Artificial Sequence
  Synthetic
  MISC_FEATURE (1)..(1): optionally absent
  MISC_FEATURE (3)..(11): optionally absent
MEQKLISEEDLQPWHGKAMQRASEAGATAPKASARNARGAPMDPTESPAAPEAALPKAGKFGPARKSGSRQKKSAPDTQERPPVRATGARAKKAPQRAQDTQPSDATSAPGAEGLEPPAAREPALSRAGSCRQRGARCSTKPRPPPGPWDVPSPGLPVSAPILVRRDAAPGASKLRAVLEKLKLSRDDISTAAGMVKGVVDHLLLRLKCDSAFRGVGLLNTGSYYEHVKISAPNEFDVMFKLEVPRIQLEEYSNTRAYYFVKFKRNPKENPLSQFLEGEILSASKMLSKFRKIIKEEINDIKDTDVIMKRKRGGSPAVTLLISEKISVDITLALESKSSWPASTQEGLRIQNWLSAKVRKQLRLKPFYLVPKHAKEGNGFQEETWRLSFSHIEKEILNNHGKSKTCCENKEEKCCRKDCLKLMKYLLEQLKERFKDKKHLDKFSSYHVKTAFFHVCTQNPQDSQWDRKDLGLCFDNCVTYFLQCLRTEKLENYFIPEFNLFSSNLIDKRSKEFLTKQIEYERNNEFPVFDEF

SEQ ID NO: 329 - RNA, 19 nt, Artificial Sequence
  Synthetic
cugaaugccugcgagcauc

SEQ ID NO: 330 - protein, 61 aa, Artificial Sequence
  Synthetic
KSIRCKNCNKLLFKADSFDHIEIRCPRCKRHIIMLNACEHPTEKHCGKREKITHSDETVRY

SEQ ID NO: 331 - protein, 521 aa, Artificial Sequence
  Synthetic
  MISC_FEATURE (1)..(1): optionally absent
  MISC_FEATURE (512)..(521): optionally absent
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGKEQKLISEEDL

SEQ ID NO: 332 - RNA, 87 nt, Artificial Sequence
  Synthetic
  misc_feature (13)..(13): n is optionally absent or an RNA packaging sequence
guuuaagagcuanugcuggaaacagcauagcaaguuuaaauaaggcuaguccguuaucaacuugaaaaaguggcaccgagucggugc

SEQ ID NO: 333 - RNA, 77 nt, Artificial Sequence
  Synthetic
  misc_feature (15)..(15): n is optionally absent or an RNA packaging sequence
guuuuaguacucugngaaacagaaucuacuaaaacaaggcaaaaugccguguuuaucucgucaacuuguuggcgaga

SEQ ID NO: 334 - RNA, 20 nt, Artificial Sequence
  Synthetic
  misc_feature (12)..(12): n is optionally absent or an RNA packaging sequence
aauuucuacucnuuguagau

SEQ ID NO: 335 - RNA, 21 nt, Artificial Sequence
  Synthetic
  misc_feature (13)..(13): n is optionally absent or an RNA packaging sequence
aauuucuacuaanguguagau

SEQ ID NO: 336 - RNA, 604 nt, Artificial Sequence
  Synthetic
ucgacaaucaaccucuggauuacaaaauuugugaaagauugacugguauucuuaacuauguugcuccuuuuacgcuauguggauacgcugcuuuaaugccuuuguaucaugcuauugcuucccguauggcuuucauuuucuccuccuuguauaaauccugguugcugucucuuuaugaggaguuguggcccguugucaggcaacguggcguggugugcacuguguuugcugacgcaacccccacugguuggggcauugccaccaccugucagcuccuuuccgggacuuucgcuuucccccucccuauugccacggcggaacucaucgccgccugccuugcccgcugcuggacaggggcucggcuguugggcacugacaauuccgugguguugucggggaagcugacguccuuuccauggcugcucgccuguguugccaccuggauucugcgcgggacguccuucugcuacgucccuucggcccucaauccagcggaccuuccuucccgcggccugcugccggcucugcggccucuuccgcgucuucgccuucgcccucagacgagucggaucucccuuugggccgccuccccgccuggaauucg

SEQ ID NO: 337 - RNA, 114 nt, Artificial Sequence
  Synthetic
  misc (1)..(1): optional 5'  RNA guide sequence
gcgaccguuuaagagcuaugcuggaaacagcauagcaaguuuaaauaaggcuaguccguuaucaacuugaaaaaguggcaccgagucggugcaauccauugcacuccggauuuu

SEQ ID NO: 338 - RNA, 97 nt, Artificial Sequence
  Synthetic
  misc_feature (1)..(1): optional 5'  RNA guide sequence
guuuaagagcuaaauccauugcacuccggauuuuagcaaguuuaaauaaggcuaguccguuaucaacuugaaaaaguggcaccgagucggugcuuuu

SEQ ID NO: 339 - RNA, 122 nt, Artificial Sequence
  Synthetic
  misc_feature (1)..(1): optional 5'  RNA guide sequence
guuuaagagcuaugcuggaaacagcauagcaaguuuaaauaaggcuaguccguuaucaacuugaaaaaguggcaccgagucggugcggucugggcgcacuucggugacgguacaggccuuuu

SEQ ID NO: 340 - RNA, 721 nt, Artificial Sequence
  Synthetic
  misc_feature (1)..(1): optional 5'  RNA guide sequence
guuuaagagcuaugcuggaaacagcauagcaaguuuaaauaaggcuaguccguuaucaacuugaaaaaguggcaccgagucggugcggucugggcgcacuucggugacgguacaggccucgacaaucaaccucuggauuacaaaauuugugaaagauugacugguauucuuaacuauguugcuccuuuuacgcuauguggauacgcugcuuuaaugccuuuguaucaugcuauugcuucccguauggcuuucauuuucuccuccuuguauaaauccugguugcugucucuuuaugaggaguuguggcccguugucaggcaacguggcguggugugcacuguguuugcugacgcaacccccacugguuggggcauugccaccaccugucagcuccuuuccgggacuuucgcuuucccccucccuauugccacggcggaacucaucgccgccugccuugcccgcugcuggacaggggcucggcuguugggcacugacaauuccgugguguugucggggaagcugacguccuuuccauggcugcucgccuguguugccaccuggauucugcgcgggacguccuucugcuacgucccuucggcccucaauccagcggaccuuccuucccgcggccugcugccggcucugcggccucuuccgcgucuucgccuucgcccucagacgagucggaucucccuuugggccgccuccccgccuggauuuu

SEQ ID NO: 341 - RNA, 174 nt, Artificial Sequence
  Synthetic
  misc_feature (1)..(1): optional 5'  RNA guide sequence
guuuaagagcuaugcuggaaacagcauagcaaguuuaaauaaggcuaguccguuaucaacuugaaaaaguggcaccgagucggugcggucugggcgcacuucggugacgguacaggccgccuagcaaccaacaguaugggucugggcgcacuucggugacgguacaggccuuuu

SEQ ID NO: 342 - RNA, 184 nt, Artificial Sequence
  Synthetic
  misc_feature (1)..(1): optional 5'  RNA guide sequence
guuuaagagcuaugcuggaaacagcauagcaaguuuaaauaaggcuaguccguuaucaacuugaaaaaguggcaccgagucggugcggucugggcgcacuucggugacgguacaggccgccuagcaaccaacaguaugggucugggcgcacuucggugacgguacaggcccauacuguuguuuu

SEQ ID NO: 343 - RNA, 108 nt, Artificial Sequence
  Synthetic
  misc_feature (1)..(1): optional 5'  RNA guide sequence
guuuaagagcuaugcuggaaacagcauagcaaguuuaaauaaggcuaguccguuaucaacuugaaaaaguggcaccgagucggugcaauccauugcacuccggauuuu

SEQ ID NO: 344 - RNA, 108 nt, Artificial Sequence
  Synthetic
  misc_feature (1)..(1): optional 5'  RNA guide sequence
guuuaagagcuaggucugggcgcacuucggugacgguacaggccuagcaaguuuaaauaaggcuaguccguuaucaacuugaaaaaguggcaccgagucggugcuuuu

SEQ ID NO: 345 - RNA, 707 nt, Artificial Sequence
  Synthetic
  misc_feature (1)..(1): optional 5'  RNA guide sequence
guuuaagagcuaggucugggcgcacuucggugacgguacaggccuagcaaguuuaaauaaggcuaguccguuaucaacuugaaaaaguggcaccgagucggugcucgacaaucaaccucuggauuacaaaauuugugaaagauugacugguauucuuaacuauguugcuccuuuuacgcuauguggauacgcugcuuuaaugccuuuguaucaugcuauugcuucccguauggcuuucauuuucuccuccuuguauaaauccugguugcugucucuuuaugaggaguuguggcccguugucaggcaacguggcguggugugcacuguguuugcugacgcaacccccacugguuggggcauugccaccaccugucagcuccuuuccgggacuuucgcuuucccccucccuauugccacggcggaacucaucgccgccugccuugcccgcugcuggacaggggcucggcuguugggcacugacaauuccgugguguugucggggaagcugacguccuuuccauggcugcucgccuguguugccaccuggauucugcgcgggacguccuucugcuacgucccuucggcccucaauccagcggaccuuccuucccgcggccugcugccggcucugcggccucuuccgcgucuucgccuucgcccucagacgagucggaucucccuuugggccgccuccccgccuggauuuu

SEQ ID NO: 346 - RNA, 97 nt, Artificial Sequence; identical to SEQ ID NO: 338
  Synthetic
  misc_feature (1)..(1): optional 5'  RNA guide sequence

SEQ ID NO: 347 - RNA, 108 nt, Artificial Sequence; identical to SEQ ID NO: 344
  Synthetic
  misc_feature (1)..(1): optional 5'  RNA guide sequence

SEQ ID NO: 348 - RNA, 108 nt, Artificial Sequence; identical to SEQ ID NO: 344
  Synthetic
  misc_feature (1)..(1): optional 5'  RNA guide sequence

SEQ ID NO: 349 - RNA, 114 nt, Artificial Sequence
  Synthetic
  misc_feature (1)..(1): optional 5'  RNA guide sequence
  misc_feature (109)..(114): optionally absent
guuuuagagcuagaaauagcaaguuaaaauaaggcuaguccguuaucaacuugaaaaaguggcaccgagucggugcggucugggcgcacuucggugacgguacaggccuuuuuu

SEQ ID NO: 350 - RNA, 110 nt, Artificial Sequence
  Synthetic
  misc_feature (1)..(1): optional 5'  RNA guide sequence
  misc_feature (115)..(120): optionally absent
guuuuagagcuaggucugggcgcacuucggugacgguacaggccuagcaaguuaaaauaaggcuaguccguuaucaacuugaaaaaguggcaccgagucggugcuuuuuu

SEQ ID NO: 351 - RNA, 82 nt, Artificial Sequence
  Synthetic
  misc_feature (1)..(1): optional 5'  RNA guide sequence
  misc_feature (77)..(82): optionally absent
guuuuaguacucuggaaacagaaucuacuaaaacaaggcaaaaugccguguuuaucucgucaacuuguuggcgagauuuuuu

SEQ ID NO: 352 - RNA, 83 nt, Artificial Sequence
  Synthetic
  misc_feature (1)..(1): optional 5'  RNA guide sequence
  misc_feature (15)..(15): n is an optional RNA packaging sequence
  misc_feature (78)..(83): optionally absent
guuuuaguacucugngaaacagaaucuacuaaaacaaggcaaaaugccguguuuaucucgucaacuuguuggcgagauuuuuu

SEQ ID NO: 353 - RNA, 83 nt, Artificial Sequence
  Synthetic
  misc_feature (1)..(1): optional 5' RNA guide sequence
  misc_feature (77)..(77): n is an optional RNA packaging suquence
  misc_feature (78)..(83): optionally absent
guuuuaguacucuggaaacagaaucuacuaaaacaaggcaaaaugccguguuuaucucgucaacuuguuggcgaganuuuuuu

SEQ ID NO: 354 - RNA, 19 nt, Artificial Sequence
  Synthetic
  misc_feature (19)..(19): optional 3'  RNA guide sequence
aauuucuacucuuguagau

SEQ ID NO: 355 - RNA, 20 nt, Artificial Sequence
  Synthetic
  misc_feature (12)..(12): n in an optional RNA guide sequence
  misc_feature (20)..(20): optional 3' RNA guide sequence
aauuucuacucnuuguagau

SEQ ID NO: 356 - RNA, 20 nt, Artificial Sequence
  Synthetic
  misc_feature (1)..(1): n is an optional RNA packaging sequence
  misc_feature (20)..(20): optional 3' RNA sequence
naauuucuacucuuguagau

SEQ ID NO: 357 - RNA, 20 nt, Artificial Sequence
  Synthetic
  misc_feature (19)..(20): optional RNA guide sequence
  misc_feature (20)..(20): optional 3' RNA packaging sequence
aauuucuacucuuguagaun

SEQ ID NO: 358 - RNA, 20 nt, Artificial Sequence
  Synthetic
  misc_feature (20)..(20): optional RNA guide sequence
aauuucuacuaaguguagau

SEQ ID NO: 359 - RNA, 21 nt, Artificial Sequence
  Synthetic
  misc_feature (13)..(13): n is an optional RNA packaging sequence
  misc_feature (21)..(21): optional 3' RNA guidance sequence
aauuucuacuaanguguagau

SEQ ID NO: 360 - RNA, 21 nt, Artificial Sequence
  Synthetic
  misc_feature (1)..(1): n is an optional RNA packaging sequence
  misc_feature (21)..(21): optional 3' RNA guide sequence
naauuucuacuaaguguagau

SEQ ID NO: 361 - RNA, 21 nt, Artificial Sequence
  Synthetic
  misc_feature (20)..(21): optional RNA guide sequence
  misc_feature (21)..(21): optional 3' RNA packaging sequence
aauuucuacuaaguguagaun

SEQ ID NO: 362 - RNA, 14 nt, Artificial Sequence
  RNA guide sequence
gugacgcuuuaccu

SEQ ID NO: 363 - RNA, 20 nt, Artificial Sequence
  RNA guide sequence
gugacgcuuuaccugcgacc

SEQ ID NO: 364 - RNA, 20 nt, Artificial Sequence
  RNA guide sequence
ggagauguuucaugcuacag

SEQ ID NO: 365 - RNA, 21 nt, Artificial Sequence
  RNA guide sequence
gugaaugaccaggguaccugc

SEQ ID NO: 366 - RNA, 21 nt, Artificial Sequence
  RNA guide sequence
gacagcccaagugaaugacca

SEQ ID NO: 367 - protein, 1368 aa, Artificial Sequence [sequence omitted]

SEQ ID NO: 368 - protein, 1612 aa, Artificial Sequence
  Synthetic
  MISC_FEATURE (1)..(1): optionally absent
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 369 - protein, 1700 aa, Artificial Sequence
  Synthetic
  MISC_FEATURE (1)..(1): optionally absent
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLS

SEQ ID NO: 370 - protein, 1052 aa, Artificial Sequence
  Synthetic
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 371 - protein, 1228 aa, Artificial Sequence
  Synthetic
AASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGAAGYKSLFKKDIIETILPEAADDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNAKTKQALPKFKPLYKQVLSDRESLSFYGEGYTSDEEVLEVFRNTLNKNSEIFSSIKKLEKLFKNFDEYSSAGIFVKNGPAISTISKDIFGEWNLIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFAAAKKNNVFAWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVK

SEQ ID NO: 372 - protein, 1307 aa, Artificial Sequence
  Synthetic
  MISC_FEATURE (1)..(1): optionally absent
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 373 - RNA, 4125 nt, Artificial Sequence
  Synthetic
gguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggaaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgac

SEQ ID NO: 374 - RNA, 5040 nt, Artificial Sequence
  Synthetic
  misc_feature (33)..(171): optionally absent
  misc_feature (4296)..(4348): optionally absent
  misc_feature (4426)..(5040): optionally absent
ggucugggcgcacuucggugacgguacaggccuaggauuacugcucggugacuuauaaucauccuccccgccaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggaaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaaaaggccggcggccacgaaaaaggccggccaggcaaaaaagaaaaagugagguaccgucgcacacauccuauuugggccuagcaaccaacaguaugggucugggcgcacuucggugacgguacaggccgucacgguucuucgacaaucaaccucuggauuacaaaauuugugaaagauugacugguauucuuaacuauguugcuccuuuuacgcuauguggauacgcugcuuuaaugccuuuguaucaugcuauugcuucccguauggcuuucauuuucuccuccuuguauaaauccugguugcugucucuuuaugaggaguuguggcccguugucaggcaacguggcguggugugcacuguguuugcugacgcaacccccacugguuggggcauugccaccaccugucagcuccuuuccgggacuuucgcuuucccccucccuauugccacggcggaacucaucgccgccugccuugcccgcugcuggacaggggcucggcuguugggcacugacaauuccgugguguugucggggaagcugacguccuuuccauggcugcucgccuguguugccaccuggauucugcgcgggacguccuucugcuacgucccuucggcccucaauccagcggaccuuccuucccgcggccugcugccggcucugcggccucuuccgcgucuucgccuucgcccucagacgagucggaucucccuuugggccgccuccccgccuggaauucg

SEQ ID NO: 375 - RNA, 4411 nt, Artificial Sequence
  Synthetic
  misc_feature (29)..(167): optionally absent
  misc_feature (4310)..(4383): optionally absent
ggcucguguagcucauuagcuccgagccuaggauuacugcucggugacuuauaaucauccuccccgccaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggaaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaaaaggccggcggccacgaaaaaggccggccaggcaaaaaagaaaaagugagucgcacacauccuauuugggccuagcaaccaacaguaugggcucguguagcucauuagcuccgagcc

SEQ ID NO: 376 - RNA, 4976 nt, Artificial Sequence
  Synthetic
  misc_feature (1)..(139): optionally absent
  misc_feature (4265)..(4976): optionally absent
uaggauuacugcucggugacuuauaaucauccuccccgccaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggaaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaaaaggccggcggccacgaaaaaggccggccaggcaaaaaagaaaaagugagguaccgucgcacacauccuauuugggccuagcaaccaacaguauggucacgguucuucgacaaucaaccucuggauuacaaaauuugugaaagauugacugguauucuuaacuauguugcuccuuuuacgcuauguggauacgcugcuuuaaugccuuuguaucaugcuauugcuucccguauggcuuucauuuucuccuccuuguauaaauccugguugcugucucuuuaugaggaguuguggcccguugucaggcaacguggcguggugugcacuguguuugcugacgcaacccccacugguuggggcauugccaccaccugucagcuccuuuccgggacuuucgcuuucccccucccuauugccacggcggaacucaucgccgccugccuugcccgcugcuggacaggggcucggcuguugggcacugacaauuccgugguguugucggggaagcugacguccuuuccauggcugcucgccuguguugccaccuggauucugcgcgggacguccuucugcuacgucccuucggcccucaauccagcggaccuuccuucccgcggccugcugccggcucugcggccucuuccgcgucuucgccuucgcccucagacgagucggaucucccuuugggccgccuccccgccuggaauucg

SEQ ID NO: 377 - RNA, 5019 nt, Artificial Sequence
  Synthetic
  misc_feature (22)..(160): optionally absent
  misc_feature (4286)..(4286): n is a, c, g, or u
  misc_feature (4287)..(4383): optionally absent
  misc_feature (4404)..(5019): optionally absent
aauccauugcacuccggauuuuaggauuacugcucggugacuuauaaucauccuccccgccaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggaaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacnaaaaggccggcggccacgaaaaaggccggccaggcaaaaaagaaaaagugagguaccgucgcacacauccuauuugggccuagcaaccaacaguaugaauccauugcacuccggauuugucacgguucuucgacaaucaaccucuggauuacaaaauuugugaaagauugacugguauucuuaacuauguugcuccuuuuacgcuauguggauacgcugcuuuaaugccuuuguaucaugcuauugcuucccguauggcuuucauuuucuccuccuuguauaaauccugguugcugucucuuuaugaggaguuguggcccguugucaggcaacguggcguggugugcacuguguuugcugacgcaacccccacugguuggggcauugccaccaccugucagcuccuuuccgggacuuucgcuuucccccucccuauugccacggcggaacucaucgccgccugccuugcccgcugcuggacaggggcucggcuguugggcacugacaauuccgugguguugucggggaagcugacguccuuuccauggcugcucgccuguguugccaccuggauucugcgcgggacguccuucugcuacgucccuucggcccucaauccagcggaccuuccuucccgcggccugcugccggcucugcggccucuuccgcgucuucgccuucgcccucagacgagucggaucucccuuugggccgccuccccgccuggaauucg

SEQ ID NO: 378 - RNA, 5026 nt, Artificial Sequence
  Synthetic
  misc_feature (28)..(167): optionally absent
  misc_feature (4293)..(4383): optionally absent
  misc_feature (4911)..(5026): optionally absent
ggcucguguagcucauuagcuccgagccuaggauuacugcucggugacuuauaaucauccuccccgccaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggaaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaaaaggccggcggccacgaaaaaggccggccaggcaaaaaagaaaaagugagucgcacacauccuauuugggccuagcaaccaacaguaugggcucguguagcucauuagcuccgagccgucacgguucuucgacaaucaaccucuggauuacaaaauuugugaaagauugacugguauucuuaacuauguugcuccuuuuacgcuauguggauacgcugcuuuaaugccuuuguaucaugcuauugcuucccguauggcuuucauuuucuccuccuuguauaaauccugguugcugucucuuuaugaggaguuguggcccguugucaggcaacguggcguggugugcacuguguuugcugacgcaacccccacugguuggggcauugccaccaccugucagcuccuuuccgggacuuucgcuuucccccucccuauugccacggcggaacucaucgccgccugccuugcccgcugcuggacaggggcucggcuguugggcacugacaauuccgugguguugucggggaagcugacguccuuuccauggcugcucgccuguguugccaccuggauucugcgcgggacguccuucugcuacgucccuucggcccucaauccagcggaccuuccuucccgcggccugcugccggcucugcggccucuuccgcgucuucgccuucgcccucagacgagucggaucucccuuugggccgccuccccgccuggaauucg

SEQ ID NO: 379 - protein, 302 aa, Artificial Sequence
  Synthetic
  MISC_FEATURE (1)..(1): optionally absent
  MISC_FEATURE (222)..(231): Myc Tag - optionally absent
  MISC_FEATURE (283)..(289): linker - optionally absent
MGARASGSKSGSGSDSGSKIEELFKKHKIVAVLRANSVEEAKEKALAVFEGGVHLIEITFTVPDADTVIKELSFLKEKGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPDEVREKAKAFVEKIRGCTEQKLISEEDLQSRPEPTAPPEESFRSGVETTTPPQKQEPIDKELYPLTSLRSLFGNDPSSQGGSKGSRPRGTRGKGRRIRR

SEQ ID NO: 380 - protein, 306 aa, Artificial Sequence
  Synthetic
  MISC_FEATURE (1)..(1): optionally absent
  MISC_FEATURE (269)..(277): Myc Tag - optionally absent
  MISC_FEATURE (278)..(284): linker - optionally absent
MGCIKSKRKDNLNLQSRPEPTAPPEESFRSGVETTTPPQKQEPIDKELYPLTSLRSLFGNDPSSQKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGGSKGSDRRRRGSRPSGAERRRRRAAAA

SEQ ID NO: 381 - protein, 306 aa, Artificial Sequence
  Synthetic
  MISC_FEATURE (1)..(1): optionally absent
  MISC_FEATURE (269)..(277): Myc Tag - optionally absent
  MISC_FEATURE (278)..(284): linker - optionally absent
MGCIKSKRKDNLNLQSRPEPTAPPEESFRSGVETTTPPQKQEPIDKELYPLTSLRSLFGNDPSSQKIEELFKKHKIVAVLRANSVEEAKEKALAVFEGGVHLIEITFTVPDADTVIKELSFLKEKGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPDEVREKAKAFVEKIRGCTEQKLISEEDLGGSKGSDRRRRGSRPSGAERRRRRAAAA

SEQ ID NO: 382 - protein, 298 aa, Artificial Sequence
  Synthetic
  MISC_FEATURE (1)..(1): optionally absent
  MISC_FEATURE (269)..(277): Myc Tag - optionally absent
  MISC_FEATURE (278)..(284): Myc Tag - optionally absent
MGCIKSKRKDNLNLQSRPEPTAPPEESFRSGVETTTPPQKQEPIDKELYPLTSLRSLFGNDPSSQKIEELFKKHKIVAVLRANSVEEAKEKALAVFEGGVHLIEITFTVPDADTVIKELSFLKEKGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPDEVREKAKAFVEKIRGCTEQKLISEEDLGGSKGSRPRGTRGKGRRIRR

SEQ ID NO: 383 - protein, 381 aa, Artificial Sequence
  Synthetic
  MISC_FEATURE (1)..(1): optionally absent
  MISC_FEATURE (269)..(277): Myc Tag - optionally absent
  MISC_FEATURE (278)..(284): linker - optionally absent
MGCIKSKRKDNLNLQSRPEPTAPPEESFRSGVETTTPPQKQEPIDKELYPLTSLRSLFGNDPSSQKIEELFKKHKIVAVLRANSVEEAKEKALAVFEGGVHLIEITFTVPDADTVIKELSFLKEKGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPDEVREKAKAFVEKIRGCTEQKLISEEDLGGSKGSAVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 384 - protein, 345 aa, Artificial Sequence
  Synthetic
  MISC_FEATURE (1)..(1): optionally absent
  MISC_FEATURE (269)..(277): Myc Tag - optionally absent
  MISC_FEATURE (278)..(284): linker - optionally absent
MGCIKSKRKDNLNLQSRPEPTAPPEESFRSGVETTTPPQKQEPIDKELYPLTSLRSLFGNDPSSQKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGGSKGSKSIRCKNCNKLLFKADSFDHIEIRCPRCKRHIIMLNACEHPTEKHCGKREKITHSDETVRY

SEQ ID NO: 385 - protein, 339 aa, Artificial Sequence
  Synthetic
  MISC_FEATURE (1)..(1): optionally absent
  MISC_FEATURE (269)..(277): Myc Tag - optionally absent
  MISC_FEATURE (278)..(284): linker - optionally absent
MGCIKSKRKDNLNLQSRPEPTAPPEESFRSGVETTTPPQKQEPIDKELYPLTSLRSLFGNDPSSQKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGGSKGSMQKGNFRNQRKTVKCFNCGKEGHIAKNCRAPRKKGCWKCGKEGHQMKDCTERQAN

SEQ ID NO: 386 - protein, 298 aa, Artificial Sequence
  Synthetic
  MISC_FEATURE (1)..(1): optionally absent
  MISC_FEATURE (269)..(277): Myc Tag - optionally absent
  MISC_FEATURE (278)..(284): linker - optionally absent
MGCIKSKRKDNLNLQSRPEPTAPPEESFRSGVETTTPPQKQEPIDKELYPLTSLRSLFGNDPSSQKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGGSKGSRPRGTRGKGRRIRR

SEQ ID NO: 387 - protein, 381 aa, Artificial Sequence
  Synthetic
  MISC_FEATURE (1)..(1): optionally absent
  MISC_FEATURE (269)..(277): Myc Tag - optionally absent
  MISC_FEATURE (278)..(284): linker - optionally absent
MGCIKSKRKDNLNLQSRPEPTAPPEESFRSGVETTTPPQKQEPIDKELYPLTSLRSLFGNDPSSQKIEELFKKHKIVAVLRANSVEEAKKKALAVFLGGVHLIEITFTVPDADTVIKELSFLKEMGAIIGAGTVTSVEQCRKAVESGAEFIVSPHLDEEISQFCKEKGVFYMPGVMTPTELVKAMKLGHTILKLFPGEVVGPQFVKAMKGPFPNVKFVPTGGVNLDNVCEWFKAGVLAVGVGSALVKGTPVEVAEKAKAFVEKIRGCTEQKLISEEDLGGSKGSAVPETRPNHTIYINNLNEKIKKDELKKSLHAIFSRFGQILDILVSRSLKMRGQAFVIFKEVSSATNALRSMQGFPFYDKPMRIQYAKTDSDIIAKMK

SEQ ID NO: 388 - DNA, 21 bp, Artificial Sequence
  Synthetic
actcggtgccactttttcaag

SEQ ID NO: 389 - DNA, 23 bp, Artificial Sequence
  Synthetic
ggagatgtttcatgctacaggtt

SEQ ID NO: 390 - DNA, 23 bp, Artificial Sequence
  Synthetic
ttcaagttgataacggactagcc

SEQ ID NO: 391 - DNA, 21 bp, Artificial Sequence
  Synthetic
gtgacgctttacctgcgaccg

SEQ ID NO: 392 - DNA, 23 bp, Artificial Sequence
  Synthetic
ttcaagttgataacggactagcc

SEQ ID NO: 393 - DNA, 21 bp, Artificial Sequence
  Synthetic
tgaatgaccagggtacctgcg

SEQ ID NO: 394 - DNA, 23 bp, Artificial Sequence
  Synthetic
ttcaagttgataacggactagcc

SEQ ID NO: 395 - DNA, 20 bp, Artificial Sequence
  Synthetic
taggattactgctcggtgac

SEQ ID NO: 396 - DNA, 19 bp, Artificial Sequence
  Synthetic
cgttgatggggttttcctc

SEQ ID NO: 397 - DNA, 20 bp, Artificial Sequence
  Synthetic
agatgatcgccaagagcgag

SEQ ID NO: 398 - DNA, 20 bp, Artificial Sequence
  Synthetic
ccaaataggatgtgtgcgac

SEQ ID NO: 399 - DNA, 22 bp, Artificial Sequence
  Synthetic
ctgaacagaaacagatggtggc

SEQ ID NO: 400 - DNA, 22 bp, Artificial Sequence
  Synthetic
ccttctggactacaaacaaacc

SEQ ID NO: 401 - DNA, 20 bp, Artificial Sequence
  Synthetic
tctgctggctttctgaggtt

SEQ ID NO: 402 - DNA, 21 bp, Artificial Sequence
  Synthetic
ggcatgtttactctgcagctc

SEQ ID NO: 403 - DNA, 20 bp, Artificial Sequence
  Synthetic
cgacatcatggaccccacaa

SEQ ID NO: 404 - DNA, 20 bp, Artificial Sequence
  Synthetic
gggcgtttctcaaagcactg

SEQ ID NO: 405 - DNA, 20 bp, Artificial Sequence
  Synthetic
cctccaacatgacctgggac

SEQ ID NO: 406 - DNA, 20 bp, Artificial Sequence
  Synthetic
agccaccaaccccaattgat

SEQ ID NO: 407 - RNA, 20 nt, Artificial Sequence
  guide sequence
gaagcgccuggcaguguacc

SEQ ID NO: 408 - RNA, 20 nt, Artificial Sequence
  guide sequence
gugacgcuuuaccugcgacc

SEQ ID NO: 409 - RNA, 19 nt, Artificial Sequence
  guide sequence
gucaagagcaacagugcug

SEQ ID NO: 410 - RNA, 20 nt, Artificial Sequence
  guide sequence
ggcccagacugagcacguga

SEQ ID NO: 411 - RNA, 108 nt, Artificial Sequence; identical to SEQ ID NO: 343
  Synthetic
  misc_feature (1)..(1): optional 5' RNA guide sequence
  misc_feature (105)..(108): optionally absent

SEQ ID NO: 412 - RNA, 97 nt, Artificial Sequence; identical to SEQ ID NO: 338
  Synthetic
  misc_feature (1)..(1): optional 5' RNA guide sequence
  misc_feature (94)..(97): optionally absent

SEQ ID NO: 413 - RNA, 122 nt, Artificial Sequence; identical to SEQ ID NO: 339
  Synthetic
  misc_feature (1)..(1): optional 5' RNA guide sequence
  misc_feature (119)..(122): optionally absent

SEQ ID NO: 414 - RNA, 108 nt, Artificial Sequence; identical to SEQ ID NO: 344
  Synthetic
  misc_feature (1)..(1): optional 5' RNA guide sequence
  misc_feature (105)..(108): optionally absent

SEQ ID NO: 415 - DNA, 23 bp, Artificial Sequence
  Synthetic
ggagatgtttcatgctacagtgg

We claim:

1. A composition comprising:

(a) a multimeric assembly, comprising a plurality of oligomeric substructures, wherein each oligomeric substructure comprises a plurality of recombinant polypeptides that self-interact around at least one axis of rotational symmetry, wherein (i) each of the recombinant polypeptides comprises a polypeptide-polypeptide interface ("O interface"):

(ii) one or more of the recombinant polypeptides comprises a polypeptide domain that is capable of interacting with a lipid bilayer ("M domain");

(iii) one or more of the recombinant polypeptides comprises a polypeptide domain that is capable of effecting membrane scission and release of an enveloped multimeric assembly from a cell by recruiting the ESCRT machinery to the site of budding by binding to one or more proteins in the eukaryotic ESCRT complex ("L domain"); and (iv) one or more of the recombinant polypeptides comprises an RNA binding domain ("RBD");

wherein the M domain, the L domain, the O interface, and the RBD are not each present in a single naturally occurring protein; and (b) one or more active component selected from the group consisting of:

(i) one or more RNAs comprising (A) one or more guide RNA (gRNA), wherein each gRNA comprises (I) a guide sequence capable of binding to a desired nucleic acid sequence; (II) an RNA packaging sequence capable of being bound by the RBD; and (III) a structural sequence capable of binding to a Class 2 Cas protein to form a Class 2 Clustered Regularly-Interspaced Short Palindromic Repeats (CRISPR)-Cas ribonucleoprotein (RNP) complex; and (B) one or more mRNA encoding a Class 2 Cas protein and an RNA packaging sequence capable of being bound by the RBD; and/or (ii) one or more Class 2 CRISPR-Cas RNP complexes comprising a Class 2 Cas protein and one or more gRNA bound by the Class 2 Cas protein, wherein each gRNA comprises (I) a guide sequence capable of binding to a desired nucleic acid sequence; (II) an RNA packaging sequence capable of being bound by the RBD; and (III) a structural sequence capable of binding to a Class 2 Cas protein;

wherein the structural sequence comprises or consists of a sequence that is at least 50% identical to the nucleic acid sequence selected from the group consisting of SEQ ID NOS:332-335:

(SEQ ID NO: 332)
GUUUAAGAGCUA-N-UGCUGGAAACAGCAUAGCAAGUUUAAAUAAGGC
UAGUCCGUUAUCAACUUGAAAAAGUGGCACCGAGUCGGUGC, (SEQ ID NO: 333)
GUUUUAGUACUCUG-N-GAAACAGAAUCUACUAAAACAAGGCAAAAUG
CCGUGUUUAUCUCGUCAACUUGUUGGCGAGA, (SEQ ID NO: 334)
AAUUUCUACUC-N-UUGUAGAU,
and (SEQ ID NO: 335)
AAUUUCUACUAA-N-GUGUAGAU;

wherein N is absent or comprises or consists of an RNA packaging sequence.

2. The composition of claim 1, wherein each of the recombinant polypeptides comprises an L domain, and/or wherein each of the recombinant polypeptides comprises an M domain, and/or wherein each of the recombinant polypeptides comprises an RBD.

3. The composition of claim 1, wherein the active component comprises an RNA packaging sequence capable of being bound by the RBD.

4. The composition of claim 3, wherein the RNA packaging sequence comprises or consists of a sequence that is at least 50% identical to the nucleic acid sequence of SEQ ID NO:204.

5. The composition of claim 1, wherein the one or more active component comprises:

(A) one or more gRNA; and (B) one or more mRNA encoding a Class 2 Cas protein and an RNA packaging sequence capable of being bound by the RBD; or wherein the one or more active component comprises one or more RNP complexes comprising a Class 2 Cas protein and one or more gRNA bound by the Class 2 Cas protein.

6. The composition of claim 5, wherein the gRNA comprises or consists of a sequence that is at least 50% identical to the nucleic acid sequence of SEQ ID NO:350

```
gRNA10 loop-1g70
                                          SEQ ID NO: 350
5'-X-GUUUUAGAGCUAGGUCUGGGCGCACUUCGGUGACGGUACAGGCCU

AGCAAGUUAAAAUAAGGCUAGUCCGUUAUCAACUUGAAAAAGUGGCACCG

AGUCGGUGC(UUUUUU);
``` wherein X is an RNA Guide.

7. The composition of claim 5, wherein the Class 2 Cas protein comprises an amino acid sequence having at least 50% identity to the amino acid sequence of SEQ ID NO:367.

8. The composition of claim 5, wherein the mRNA encoding a Class 2 Cas protein comprises a nucleotide sequence having at least 50% identity to the nucleic acid sequence of SEQ ID NO:373.

9. The composition of claim 1, wherein the RBD comprises the amino acid sequence of SEQ ID NOS:201.

10. The composition of claim 1, wherein the one or more O interfaces of each oligomeric substructure are identical.

11. The composition of claim 1, wherein the one or more O interfaces comprise or consist of the amino acid sequence of SEQ ID NO:304.

12. The composition of claim 1, wherein the one or more L domains comprise the amino acid sequence of SEQ ID NO:172.

13. The composition of claim 1, wherein the one or more M domains comprise the amino acid sequence of SEQ ID NO:280.

14. The composition of claim 1, wherein the recombinant polypeptide comprises the amino acid sequence of SEQ ID NOS:266.

15. A recombinant host cell capable of producing the composition of claim 1.

* * * * *